(12) United States Patent
Schoeters et al.

(10) Patent No.: US 8,412,459 B2
(45) Date of Patent: Apr. 2, 2013

(54) METHOD FOR DETERMINING THE ALLERGIC POTENTIAL OF A COMPOUND

(75) Inventors: Greet Schoeters, Mol (BE); Rosette Van Den Heuvel, Merksplas (BE); Jef Hooyberghs, Mol (BE)

(73) Assignee: Vlaamse Instelling Voor Technologisch Onderzoek (VITO), Mol (BE)

( * ) Notice: Subject to any disclaimer, the term of this patent is extended or adjusted under 35 U.S.C. 154(b) by 552 days.

(21) Appl. No.: 12/443,639

(22) PCT Filed: Sep. 28, 2007

(86) PCT No.: PCT/EP2007/060342
§ 371 (c)(1),
(2), (4) Date: Mar. 30, 2009

(87) PCT Pub. No.: WO2008/037806
PCT Pub. Date: Apr. 3, 2008

(65) Prior Publication Data
US 2010/0240032 A1  Sep. 23, 2010

(30) Foreign Application Priority Data
Sep. 29, 2006  (EP) ..................................... 06447110

(51) Int. Cl.
*G06F 7/00*  (2006.01)
(52) U.S. Cl. ................ 702/19; 702/20; 703/11; 703/12; 707/700
(58) Field of Classification Search .......................... None
See application file for complete search history.

(56) References Cited

PUBLICATIONS

Hooyberghs et al., Toxicity and Applied Pharmacology 231, pp. 103-111, Apr. 4, 2008.*
Loveren et al., Regulatory Toxicology and Pharmacology 50 (2008) 155-199.*
Worth et al., Predicting Toxicological and Ecotoxicolgical Endpoints, in "Risk Assessment of Chemicals," 2007.*
Schoeters, E., et al., Expression analysis of immune-related genes in CD34+ progenitor-derived dendritic cells after exposure to the chemical contact allergen DNCB, Toxicology in Vitro, (2005), pp. 909-913, 19.
Schoeters, Elke, et al., Gene expression signatures in CD34+—progenitor derived dendritic cells expsed to the chemical contact allergen nickel sulfate, Toxicology and Applied Pharmacology, (2006), pp. 131-149, 216.
Smedt, Ann C.A., et al., Capacity of CD34+ progenitor-derived dendritic cells to distinguish between sensitizers and irritants, Toxicology Letters, (2005), pp. 377-389, 156.
Verheyen, Geert R., et al., Cytokine transcript profiling in CD34+—progenitor derived dendritic cells exposed to contact allergens and irritants, Toxicology Letter, (2005), pp. 187-194, 155.

* cited by examiner

*Primary Examiner* — Mary Zeman
(74) *Attorney, Agent, or Firm* — Sughrue Mion, PLLC

(57) ABSTRACT

The present invention is related to a method for determining the sensitizing potential of a chemical (test) compound, comprising the steps of:
(a) Providing a suitable cell culture of a specific cell type and providing a test sample and a control sample thereof, said test sample and said control sample being identical,
(b) Exposing said test sample to a chemical compound in a solvent and exposing said control sample to said solvent for a predetermined period of time,
(c) Determining for the test sample and the control sample gene expressions $x_i$ for a subset of i=1 to n genes selected from the group of genes corresponding to SEQ ID NOs 1 to 153,
(d) For this subset of n genes looking up in a database the gene expressions $x_i$ for a set of control and test samples, the test samples being exposed for said predetermined period of time to a set of chemical sensitizing model compounds comprising both sensitizers and non-sensitizers,
(e) Using the gene expressions of the said test sample and the said control sample of step (c) as input to a statistical classification model that is based on said database and that is trained and optimized to classify chemical compounds as either sensitizers or non-sensitizers using gene expressions $x_i$ for said subset of n genes, and
(f) Predicting through said model whether the chemical compound tested belongs to the class of sensitizers or to the class of non-sensitizers.

20 Claims, 4 Drawing Sheets

METHOD FOR DETERMINING THE ALLERGIC POTENTIAL OF A COMPOUND

FIELD OF THE INVENTION

The present invention is related to a method for determining the allergic or sensitizing potential (also called allergenicity) of a chemical compound, more in particular the allergenicity of a compound in relation with allergic contact dermatitis. The method may be extended to other types of Type IV T cell-mediated hypersensitivity diseases (e.g. respiratory and food allergy).

STATE OF THE ART

Allergic diseases affect up to 20% of the population in the developed countries. In the workplace, irritant and allergic contact dermatitis account for about 40% of occupational illness. They are the most common cause of school absence, a substantial cause for absenteeism from work and interfere with the quality of life of adults. The economic burden of contact dermatitis is extensive because of the dual impact on health care cost and productivity. The most common cause of allergic contact dermatitis (ACD) is skin exposure to fragrances or cosmetic components (coumarin, soap, cream) and heavy metals, such as nickel, cobalt and chromium.

The steady increase in commercialized chemicals and pharmaceuticals on the one hand and the demand to reduce animal experimentation on the other hand, have been strong motives for the development of non-animal models for the prediction of the sensitizing potential of new substances. Moreover, the EU whitepaper states that 30000 chemicals should be tested for toxicity by 2012 and at this moment there are insufficient in vitro alternatives available.

The ultimate challenge for developing these tests is to apply the mechanistic understanding of allergy disorders to the alternative test methods. Most of these alternatives make use of cells involved in the sensitization phase of allergy, of which in vitro cultures of langerhans cells (LCs) and dendritic cells (DCs) or LC/DC-like cells are most promising.

LCs are antigen-presenting dendritic cells that can be found in the epidermis. They are a subtype of so-called DCs, which can be found in most peripheral tissues, especially at sites of interfaces with the environment (skin and mucosa). LCs and DCs are capable of taking up allergens and processing them. During this process, the LC/DC gets activated and starts to mature. They migrate to the lymph nodes and there they present the processed allergen to T-cells. Allergen-specific T cells may recognize the antigen, become activated and undergo clonal expansion, thereby initiating the adaptive immune response.

LCs/DCs constitute a small fraction (1-3%) of all cells in tissues where they reside and therefore it is difficult to isolate them in sufficient numbers. The development of culture techniques to generate dendritic cells (DCs) from $CD34^+$ hematopoietic progenitor cells (CD34-DC) from cord blood (or bone marrow) in the presence of specific cytokines, has provided a source of LC/DC-like antigen-presenting cells, which have the antigen-processing and -presenting potential of LCs/DCs and are able to stimulate naïve T cells in the lymph nodes. Alternatively, DCs generated from $CD14^+$ monocytes from peripheral blood can be used as a cell model, but yields are usually low, compared to $CD34^+$-derived DCs.

The immunobiological mechanisms that are required for ACD and other Type IV hypersensitivity diseases are complex and dependent on highly orchestrated molecular and cellular interactions. Recent progress in genomics technology has provided tools for the investigation and interpretation of important biochemical events in the processes of allergy. DNA chips, or microarrays, permit the quantitative comparison of the expression levels of thousands of individual genes in different biological samples, for instance between control cells and toxicant-treated cells.

There is thus a need for a fast, inexpensive and (high-throughput) screening system that would allow to quickly and surely identify the allergic potential of known and new chemical compounds.

AIMS OF THE INVENTION

The present invention aims to provide a fast, inexpensive and (high-throughput) in vitro test for determining the allergic potential of chemical compounds.

SUMMARY OF THE INVENTION

The present invention concerns a method for determining the sensitizing potential of a chemical compound (also referred to as "test compound"), comprising the steps of:

(a) Providing a suitable cell culture of a specific cell type and providing a test sample and a control sample thereof, said test sample and said control sample being identical, (b) Exposing said test sample to a chemical compound in a solvent and exposing said control sample to said solvent for a predetermined period of time, (c) Determining for the test sample and the control sample gene expressions $x_i$ for a subset of i=1 to n genes selected from the group of genes corresponding to SEQ ID NOs 1 to 153 (also referred to as the "candidate genes"), (d) For this subset of n genes looking up (consulting) in a database the gene expressions $x_i$ for a set of control and test samples, the test samples being exposed for said predetermined period of time to a set of chemical sensitizing model compounds comprising both sensitizers and non-sensitizers, (e) Using the gene expressions of the said test sample and the said control sample of step (c) as input to a statistical classification model that is based on said database and that is trained and optimized to classify chemical compounds as either sensitizers or non-sensitizers using gene expressions $x_i$ for said subset of n genes, and (f) Predicting through said model whether the chemical compound tested belongs to the class of sensitizers or to the class of non-sensitizers.

The database at least comprises gene expressions $x_i$ for a set of control and test samples. Preferably, according to the invention, the database contains gene expressions $x_i$ for all genes corresponding to SEQ ID NOs 1 to 153. The person skilled in the art may construct (build) its own database or may look up the gene expressions in a database previously constructed.

The present invention also encompasses allelic variants and mutants of genes corresponding to SEQ ID NOs 1 to 153.

In other words, the database may also contain gene expressions $x_i$ for all genes corresponding to SEQ ID NOs 1 to 153 and for allelic variants and mutants thereof.

An "allelic variant" of a gene originates from variation in the DNA base sequence of the gene, giving rise to different mRNA isoforms and splice variants of the gene, and possible different gene products.

"Allelic variant" is meant to refer to a sequence that occurs at essentially the same locus (or loci) as its reference sequence, but which, due to natural variations caused by, for example, mutation or recombination, has a similar but not identical sequence. Allelic variants are well known to those skilled in the art and would be expected to be found within intergenic sequences.

The term "mutant" refers to any new genetic character arising or resulting from an instance of mutation, which is a sudden structural change within the DNA of a gene or chromosome of an organism resulting in the creation of a new character or trait not found in the wildtype.

In the present invention, a mutation is a permanent change in the DNA sequence of a gene. Mutations in a gene's DNA sequence can alter the amino acid sequence of the protein encoded by the gene. The term includes point mutations, deletion mutations (mutations by deletion) and insertion mutations (mutations by insertion).

The present invention is also related to a method for determining the sensitizing potential of a chemical compound, comprising the steps of:

(a) Providing a suitable cell culture of a specific cell type and providing a test sample and a control sample thereof, said test sample and said control sample being identical, (b) Exposing said test sample to a chemical compound in a solvent and exposing said control sample to said solvent for a predetermined period of time, (c) Determining for the test sample and the control sample gene expressions $x_i$ for a subset of i=1 to n genes selected from the group of genes corresponding to SEQ ID NOs 1 to 153, most preferably from the group of genes corresponding to SEQ ID NOs 1 to 29 and SEQ. ID. Nos 31 to 45.

(d) For this subset of n genes looking up in a database the gene expressions $x_i$ for a set of control and test samples, the test samples being exposed for said predetermined period of time to a set of chemical sensitizing model compounds comprising both sensitizers and non-sensitizers, (e) Using the gene expressions of the said test sample and the said control sample of step (c) as input to a statistical classification model that is based on said database and that is trained and optimized to classify chemical compounds as either sensitizers or non-sensitizers using gene expressions $x_i$ for said subset of n genes, and (f) Predicting through said model whether the chemical compound tested belongs to the class of sensitizers or to the class of non-sensitizers.

The statistical classification model (also called "predictive model") may be discriminative in nature or may be probabilistic in nature. It may be selected from one of the following: linear or quadratic discriminant models, logistic discriminant models, tree models, nearest neighbour models, neural networks, and support vector machines. The choice of a classification model will be data-driven and can change in time.

Advantageously, in the present invention, the database is a dynamical entity in time.

Preferably, the n genes in the subset as referred to in step (d) are selected on the basis of their potential to discriminate between chemical sensitizers and non-sensitizers. The candidate genes (biomarkers) are presented in Table 1 (For the GENBANK™ accession numbers, names and UNIGENE™ names, see Table 2). The most promising ones are found within groups 1 and/or 2 (SEQ ID Nos 1-14 and/or 15-45), followed by those of group 3 (SEQ ID Nos 46-153).

In particular, the most promising ones are found within groups 1 and/or 2 (SEQ ID Nos 1-14 and/or 15-29 and/or 31-45), followed by those of group 3 (SEQ ID Nos 46-153).

More particularly, the most promising genes are within groups 1 and/or 2 (SEQ ID Nos 1-14 and/or 15-29 and 31-45), followed by those of group 3 (SEQ ID Nos 46-125 and 127-153).

Most preferably, the n genes referred to in step (d) are chosen amongst those of group 1 and if in said group no sufficient number of discriminating genes are found, one adds genes from group 2 or even from group 3.

According to a preferred embodiment of the invention, the optimization of the statistical classification model is an iterative process used to fine-tune the model and to select the final subset of n genes. Advantageously, this fine-tuning also aids in selecting exposure times and exposure concentrations.

Preferably, in the present method, n is at least 1, 2, 3, 4, preferably is at least 5, advantageously is at least 10.

Preferably, in the present method, n is at least 1, 2, 3, 4, preferably is at least 5, advantageously is at least 10, most preferably is between 5 and 10.

In principle, n can be any number between 1 and 153, yet preferably the number (n) of genes is not too high to avoid over fitting.

Advantageously, the (predetermined) exposure time is between 15 minutes and 48 hours, preferably is between 3 and 24 hours.

Advantageously, the (predetermined) exposure time is between 15 minutes and 48 hours, preferably is between 6 and 24 hours.

Furthermore, in the present method, gene expressions for the test compound and/or the chemical sensitizing model compounds are determined for different exposure times, for instance at least 1, more preferably at least 2 or 3 different exposure times within said time window.

In practice, gene expressions for the test compound and/or the chemical sensitizing model compounds are determined more preferably for 1 to 3, maximally 5 exposure times within said time window.

Preferably, in the method of the invention, the database contains gene expressions $x_i$ for different concentrations of the chemical sensitizing model compounds, preferably for 1 to 3, up to 5 concentrations.

Preferably, the database contains gene expressions $x_i$ for concentration(s) of the chemical compound corresponding to concentration(s) that causes from about 0% to about 40% of cell death among cells exposed to the chemical compound (cell culture), preferably that causes about 20% of cell death, as determined by a conventional method for assessment of cytotoxicity (Balls and Fentem, 1992; Vander Plaetse and Schoeters, 1995), such as MTT assay (Mosmann, 1983), Alamar Blue assay (Ahmed et al., 1994), lactate dehydrogenase (LDH) activity release assay (Korzeniewski and Callewaert, 1983), or propidium iodide incorporation (Zarcone et al., 1986).

Preferably, in case the chemical compound to be tested does not cause cytotoxicity, the database contains gene expressions $x_i$ for concentration(s) of the chemical compound corresponding to the highest soluble dose of the compound in its solvent and 1, 2, 3 or 4 dilutions thereof:

More precisely, advantageously; in each experiment the maximal final concentration of solvent in the cell culture is 0.5%, in case the solvent is not cell culture medium. Dilutions of the compound in, its solvent are made in cell culture medium and may preferably be 1:1 (v/v), 1:4 (v/v), 1:9 (v/v), taking into account the maximal final concentration of 0.5% solvent in the cell culture.

Preferably, the database contains gene expressions $x_i$ for at least 1, preferably at least 2, more preferably at least 3 unrelated (repeated) experiments.

Advantageously, the database contains gene expressions $x_i$ for 1 to 5 unrelated (repeated) experiments.

Preferably, in the present method, also for the test compound, expressions $x_i$ are determined for at least 1, preferably at least 2 or 3 unrelated (repeated) experiments.

Advantageously, also for, the test compound, expressions $x_i$ are determined for 1 to 5 unrelated experiments.

Advantageously, in the present method, gene expressions for the chemical test compound and the chemical sensitizing model compounds (i.e. the database) are determined for different exposure times (within said time window), for different compound concentrations and for different (repeated) experiments.

Preferably, for the test compound, 1 to 3 exposure times, 1 to 3 concentrations and 1 to 5 unrelated (repeated) experiments are used.

Preferably, for the model compounds of the database the same time points and the same concentrations are used, and an equal or higher number of unrelated (repeated) experiments.

The terms "unrelated (repeated) experiments" refer to identically performed experiments, using identical methods and materials. The only difference between such experiments is that cells from unrelated donor individuals are used in the case of a primary cell type, and cells from the same origin, but different subculture phase are used in the case of a cell line.

When the cell culture used for performing the method according to the invention is a CD34-DC cell (see hereafter), "genes expressions $x_i$ for unrelated experimentals" means genes expressions $x_i$ for unrelated individuals.

When the method is performed using a CD34-DC cell culture (see hereafter), preferably, the database contains gene expressions $x_i$ for at least 1, preferably at least 2, more preferably at least 3 unrelated individuals.

When the method is performed using CD34-DC cell culture (see hereafter), advantageously, the database contains gene expressions $x_i$ for 1 to 5 unrelated individuals.

When the method is performed using CD34-DC cell culture (see hereafter), preferably, in the present method, also for the test compound, expressions $x_i$ are determined for at least 1, preferably at least 2 or 3 unrelated individuals.

When the method is performed using CD34-DC cell culture (see hereafter), advantageously, also for the test compound, expressions $x_i$ are determined for 1 to 5 unrelated individuals.

Advantageously, in the present method, gene expressions for the chemical test compound and the chemical sensitizing model compounds (i.e. the database) are determined for different exposure times (within said time window), for different compound concentrations and for different donor individuals.

Preferably, for the test compound, 1 to 3 exposure times, 1 to 3 concentrations and 1 to 5 unrelated donors individuals are used.

Preferably, for the model compounds of the database the same time points and the same concentrations are used, and an equal or higher number of unrelated donor individuals are used.

Preferably, in the method according to the invention, the non-sensitizer is an irritant.

Advantageously, the gene expressions of the test and control samples are expressed in the form of a logarithm of the fold change (LFC, see definitions), but other parameters could also be used.

Advantageously, in the invention, the suitable cell culture is a CD34-DC cell culture, or a DC-like alternative cell model or any other antigen-presenting cell model (monocytes and macrophages).

Advantageously, in the invention, the suitable cell culture is a CD34-DC cell culture. But it may also be a DC-like alternative cell model, such as CD14$^+$ monocyte-derived DCs, MUTZ-3 cell line, MUTZ-3-derived DCs, THP-1 cell line or U937 cell line.

Preferably, the step of determining the gene expression(s) comprises a step consisting of a method selected from the group consisting of cDNA or mRNA microarray, multiplex real-time RT-PCR, multiple singleplex real-time RT-PCR, competitive RT-PCR, RNase protection assay, Northern blotting, and protein dedicated (micro)arrays, Multiplex protein analyses by e.g. the Luminex system, Elisa, FACS, reporter assays and Western blotting. PCR techniques are preferred.

The method of the invention allows to predict (determine) the sensitizing potential of a (chemical) contact allergen.

In a particularly advantageous manner, the sensitizing potential of a chemical compound for allergic contact dermatitis is predicted with the method according to the invention.

However, the method could also work for other allergens, such as food, pollen, . . . .

The sensitizing potential of a chemical compound for other types of allergic reactions could also be predicted with the method according to the invention.

Non exhaustive examples of such other types of allergic reactions are respiratory allergy, asthma, allergic rhinitis, allergic conjunctivis and food allergy.

Another aspect of the invention concerns a test kit or assay comprising means and media arranged to determine the expression of a subset of genes, e.g. at least 5, 10, 20, 30, 40, 50, 60, 70, 80, 90, 100, 110, 120, 130, 140, 150 or 153 genes selected from the group consisting of (corresponding to) SEQ ID NOs 1 to 153 of a suitable cell culture exposed for a predetermined time to a chemical compound as a biological system.

The test kit can comprise a computer program, which is an implementation of the said classification model, described in more detail further in the text. Said test kit can comprise an expression detection system selected from the group consisting of cDNA or mRNA microarray, multiplex real-time RT-PCR, multiple singleplex real-time RT-PCR, competitive RT-PCR, RNase protection assay, Northern blotting, and protein dedicated (micro)arrays, Multiplex protein analyses by e.g. the Luminex system, Elisa, FACS and Western blotting.

DEFINITIONS

The term "gene expression" is used herein in its broadest context and may refer to either (m)RNA expression or protein expression.

FC=Fold change=ratio of gene expression of test sample versus control sample.

LFC=logarithm of FC; a gene with a non-zero LFC has a different gene expression for the test sample than for the control sample.

The term "sensitizer" refers to any chemical compound, of synthetic or natural origin, able to induce a sensitization reaction in an individual.

At the opposite, any chemical compound which does not lead to this sensitization reaction is referred in the present invention as a non-sensitizer.

It is meant by "irritants" a particular type of non-sensitizers. Contrary to sensitizers, irritants do not induce an immune response. They react in a non-specific way. Irritants are useful as non-sensitizers in the development of a test because they are difficult to distinguish from sensitizers.

It should be understood that the present invention relates to a method for determining the sensitizing potential of a specific (single) chemical compound.

The present invention also relates to a method for determining the sensitizing potential of a specific chemical compound, said compound corresponding to a single specific chemical compound or to a mixture of specific chemical compounds.

In other words, the term "specific chemical compound" may refer to a single specific chemical compound and/or to a mixture of specific chemical compounds.

SHORT DESCRIPTION OF THE FIGURES

Figure 4:
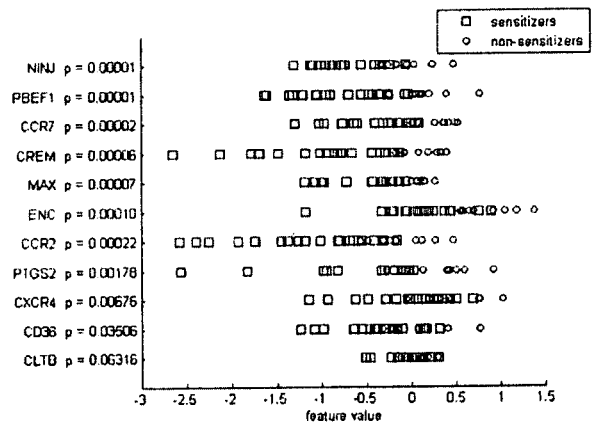

FIG. 4 gives the feature values for each gene, and the p-value for discriminating power; the compounds are grouped according to their sensitizing character.

Figure 5:
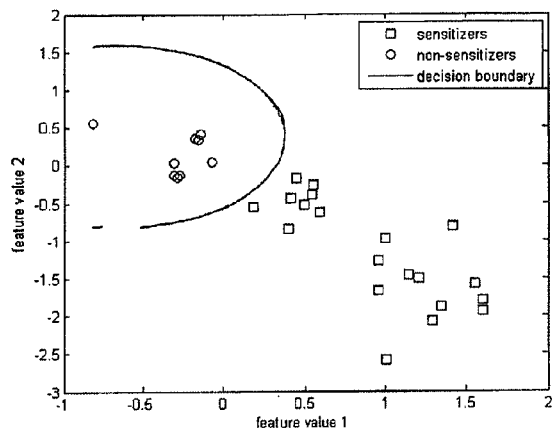
Figure 6A:
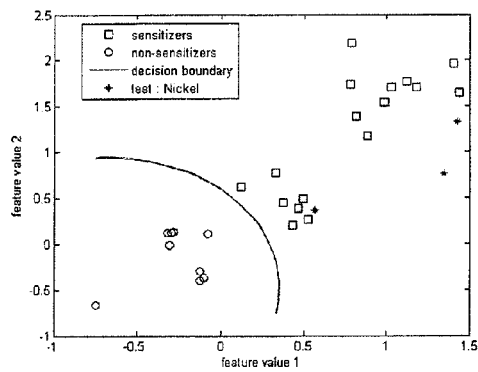
Figure 6B:
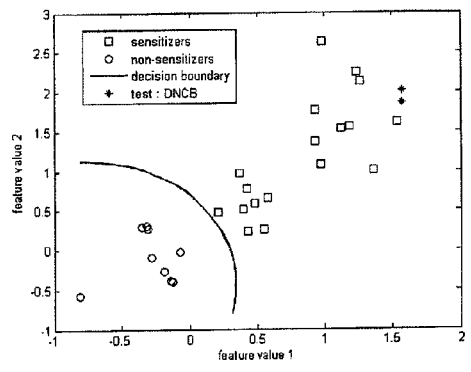
Figure 6C:
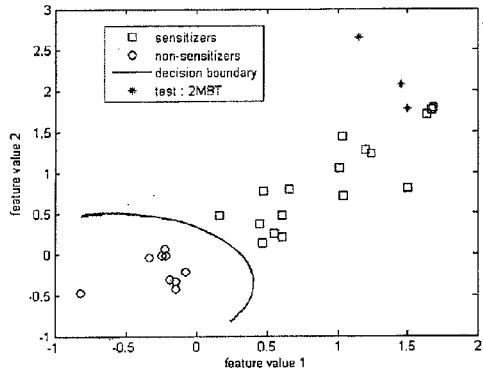
Figure 6D:
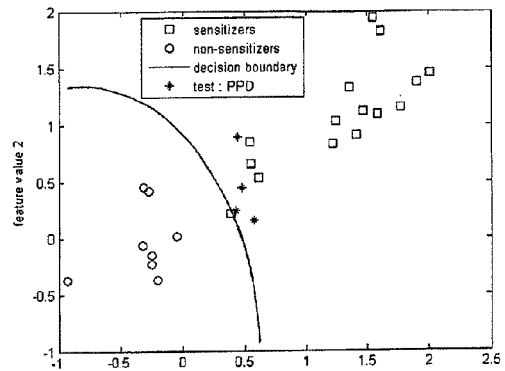
Figure 6E:
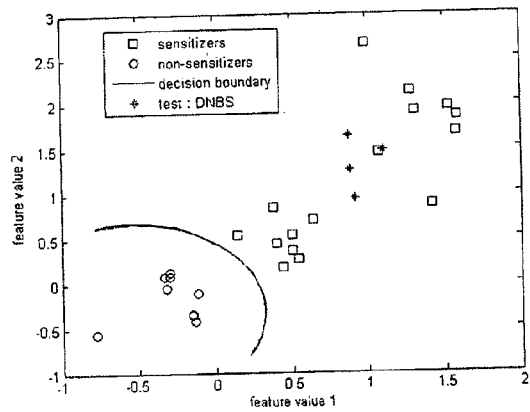
Figure 6F:
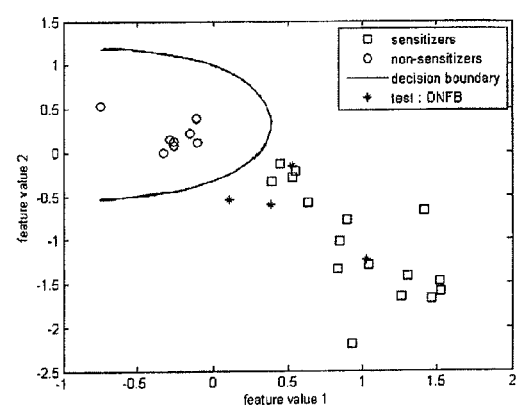
Figure 6G:
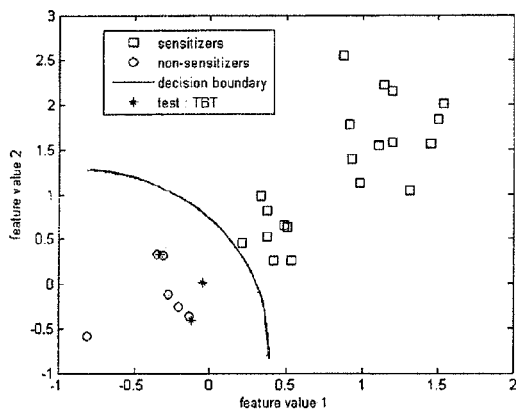
Figure 6H:
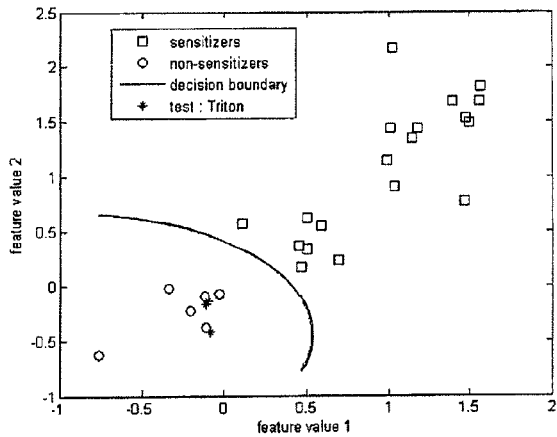
Figure 6I:
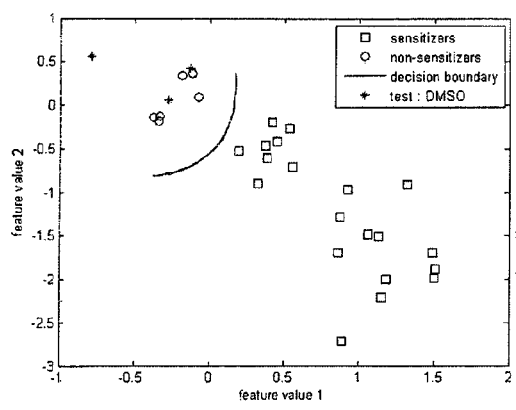

FIG. 5 shows the two dimensional representation of the data based on lda of genes NINJ, PBEF1, CCR7, CREM. Each point corresponds to one individual exposed to one compound.

FIGS. 6 A-I show results of the cross validation of the classification model by leaving out one compound (the test compound).

DETAILED DESCRIPTION OF THE INVENTION

Identification of Candidate Genes for a Test Array

CD34-DCs were used as a cell model for the development of an in vitro test assay/method according to the invention.

CD34-DCs were derived from $CD34^+$ progenitor cells present in the cord blood from participating mothers, after obtaining informed consent.

CD34-DCs were exposed to a panel (set) of chemical sensitizing model compounds comprising both sensitizers and non-sensitizers (irritants in this particular case as they are most difficult to distinguish from sensitizers). Here, CD34-DCs were exposed to 4 model chemical allergens (also called "reference allergens" or "reference sensitizers") and to 2 irritants (also called "reference irritants"). The selection of the model compounds and concentration was based on literature information. Other (or additional) reference allergens and irritants could have been chosen. The terms "reference" and "model" refer to the fact that of these compounds it is a priori known whether they are sensitizers or not.

Each CD34-DC sample was used for exposure in a time series experiment (0.5, 1, 3, 6, 12 and 24 hours exposure). At each time point, a non-exposed control sample from the same donor was also obtained. For each chemical, CD34-DCs from 3 unrelated individuals were used.

Subsequently, microarray analyses were performed for selected time points for each chemical. The microarrays used were obtained from the Vanderbilt Microarray Shared Resources Centre (USA). cDNA microarrays, containing information on about 11.000 human genes were used. They can thus be used to measure the gene expression levels of 11.000 human genes within 1 experiment.

For each chemical, at least 3 time points were selected for microarray analyses. Microarrays were run for all 3 donors, for each chemical.

Two different approaches were followed to identify appropriate candidate genes (those with a discriminating potential for sensitizers and non-sensitizers): a statistical approach and a heuristic approach which are complementary. Below some more information is provided on some of the selection criteria applied.

In a first approach, the LFC (see definition) is used and the identification procedure for candidates (biomarkers) was based on the following criteria:

In a first approach, the LFC (see definition) is used and the identification procedure for candidates (biomarkers) was based on the following criteria:

The first criteria was an altered expression for sensitizers. A t-test was used to select those genes that showed a significantly non-zero LFC after exposure to the sensitizers. This resulted in a list of 359 genes.

The second criteria was a discrimination between sensitizers and non-sensitizers. The remaining 359 genes were scored (by a t-test) on their capability to discriminate between sensitizers and irritants, the latter representing non-sensitizing compounds. The genes were ordered by increasing p-value and the top 48 were selected.

Hence, corresponding to the t-test and the FDR method, each of the remaining 48 genes has a non-zero mean LFC for the sensitizers and a different mean LFC for the irritants, both up to high degree of certainty.

Complementing these 48 genes, a second set of 10 candidate genes was added, mainly based upon known biological functionality of these genes.

In a second approach used, the magnitude of the fold change was used instead of a statistical significance. More precisely, it could be decided that candidate genes are selected according to the following criteria:

In at least 2 out of the 3 donors a gene had to have an altered expression compared to the control sample of >1.5 or <0.667.

If the same gene (selected by the criterion above) was found for 3 or 4 of the chemical sensitizers and not for the irritants, then it is included in the list of candidate genes.

The mRNA sequences corresponding to the set of 153 candidate genes selected via these 2 approaches is represented in Table 1. The first group of genes (SEQ ID NOS: 1 to 14) consists of the most promising genes that currently are being tested with RT-PCR. The second group (SEQ ID Nos: 15 to 45) are the genes one would start testing after having tested those of group 1 and if additional genes are required. Group 3 (SEQ ID Nos: 46 to 153) contains those genes that are still interesting, yet not so much as those of group 1 and 2. The most promising candidate genes are thus found on top of the list, especially amongst those of group 1. Table 2 gives the GENBANK™ accession number(s), the names and the official UNIGENE™ name(s) for each of the sequences of Table 1.

Model or Reference Chemicals Used for the Selection of the Candidate Genes (Biomarkers)

Six (chemical) compounds were tested, 4 of which are known sensitizers of different strength. Also, two irritants were included in the study. These 6 compounds are examples of the "chemical sensitizing model compounds" for which gene expressions $x_i$ are determined. Below some more information on the model compounds used.

A. Allergens

A.1. Nickel Chloride or Nickel Sulphate:

Nickel is a heavy metal that is quite abundant in the environment because of the high consumption of nickel-containing products. Nickel is classified as a moderate sensitizer.

A.2. Oxazolone (4-ethoxymethylene-oxazol-5-one):

Not much information on the applications of oxazolone can be found in the literature. It is however classified as a strong sensitizer.

A.3. DNCB (1-chloro-2,4-dinitrobenzene):

DNCB is an organic compound which is considered a strong sensitizer.

A.4. Eugenol (2-Methoxy-4-(2-propenyl)phenol):

Eugenol is a clear to pale yellow oily liquid extracted from certain essential oils especially from clove oil and cinnamon. Eugenol has only a weak sensitizing capacity.

B. Irritants

B.1. SDS (Sodium Dodecyl Sulfate, Also Known as Sodium Lauryl Sulfate):

SDS is an ionic detergent that is used in household products such as toothpastes, shampoos, shaving foams and bubble baths for its thickening effect and its ability to create lather. It is a typical irritating compound.

B.2. BC (Benzalkonium Chloride):

BC is an organic compound that is used as an antiseptic and spermicide. It is used in eyewashes, hand and face washes, mouthwashes, spermicidal creams, and in various other cleaners, sanitizers, and disinfectants.

Gene Expression Signatures in CD34+ Progenitor-Derived Dendritic Cells Exposed to the (Model) Chemical Allergens and Irritants CD34+ progenitor-derived DCs from 3 independent individuals were exposed to all compounds listed above or to the solvent (distilled water or DMSO, negative control) for 0.5, 1, 3, 6, 12 and 24 hours. Microarrays comparing exposed cultures against their equivalent time point controls, were analysed for 3 individuals for all exposure times and all compounds.

Source of Cells

Cord blood samples were collected from the umbilical vessels of placentas of normal, full-term infants immediately after delivery. Collection of the blood was done by elevating the placenta and allowing the blood to flow into heparinized tubes, containing Iscove's Modified Dulbecco's Medium (IMDM, Invitrogen, Merelbeke, Belgium), supplemented with 10% foetal bovine serum (FBS, Hyclone, Bornem, Belgium) and sodium heparin (Sigma, Bornem, Belgium) at a final concentration of 200 U/ml. Cord blood samples were stored at room temperature and handled within 24 hours after collection. Collection of cord blood samples was approved by the ethical commission of the University of Antwerp and local maternities (Moederhuis O. L. Vrouw, Geel, and Heilig Hartziekenhuis, Mol, Belgium) and a signed informed consent was obtained from the mothers participating in this study.

Cell Separation and Culture

Mononuclear cells (MNCs) were separated from the diluted cord blood (1:2 in phosphate-buffered saline (PBS, Invitrogen) by density gradient centrifugation (FICOLL PAQUE™ Plus, Amersham Biosciences, Uppsala, Sweden). This procedure was performed twice in order to avoid interference from red blood cells in the subsequent magnetic cell separation. CD34+ progenitor cells were purified from the MNCs by positive immunomagnetic selection with MIDI-MACS™, according to the procedure described by the manufacturer (Miltenyi Biotec, Bergisch Gladbach, Germany). Purities higher than 85% were obtained.

Isolated CD34+ progenitor cells were cultured according to the method described by Lardon et al. (Lardon et al. Generation of dendritic cells from bone marrow progenitors using GM-CSF (granulocyte macrophage colony stimulating factor), TNF-alpha, and additional cytokines: antagonistic effects of IL-4 and IFN-gamma and selective involvement of TNF-alpha receptor-1. *Immunology* (1997) 91(4):553-559). Briefly, CD34+ progenitor cells were cultured in a liquid assay at 37° C., 5% $CO_2$ and 95% humidity, in IMDM containing 10% FBS, 2% penicillin-streptomycin (Invitrogen) and 1% bovine serum albumin (BSA, Sigma), at a cell concentration of $1\times10^5$ cells/ml. During the first 5 days after initiation, human recombinant granulocyte macrophage-colony stimulating factor, GM-CSF (500 ng/ml; Novartis Pharma, AG, Basel, Switzerland), stem cell factor, SCF (stem cell factor) (50 ng/ml; Biosource, Nivelles, Belgium; specific activity (SA)>$10^5$ U/mg) and tumour necrosis factor-α, TNF-α (2.5 ng/ml; Boehringer Mannheim GmbH, Vilvoorde, Belgium; SA>$10^8$ U/mg) were added to the cultures. During the following 8 days, the cell culture was supplemented with 1000 U/ml IL-4 (1000 U/ml; R&D, Halle-Zoersel, Belgium; SA: $2.9\times10^4$ U/µg). After a total culture period of 12 days, the immature DC phenotype was verified and DCs were exposed to the compounds or the solvent.

Chemical Exposure of the Cells

At the end of the 12 day culture period, DCs ($4\times10^6$ cells/4 ml) from 3 individuals were exposed to the (model) compounds or the solvent for 0.5, 1, 3, 6, 12 and 24 hours. The following concentrations and solvents were used:

| Compound | Concentration | Solvent |
| --- | --- | --- |
| Nickel | 100 µM | Distilled water |
| Oxazolone | 250 µM | DMSO |
| DNCB | 10 µM | DMSO |
| Eugenol | 150 µM | Distilled water |
| SDS | 0.01% | Distilled water |
| BC | 2 µM | Distilled water |

Phenotypic Analysis by Flow Cytometry

After 12 days of culture, the expression of surface markers was analysed using flow cytometry. One million cells were harvested from the cultures, counted and aliquots of 105 cells in 50 µl PBS+10% FBS were prepared. Cells were incubated with +/−0.5 µg of monoclonal antibodies (mAb) conjugated to either fluorescein isothiocyanate (FITC) or phycoerythrin (PE) at 4° C. for 30 minutes. The following mAb were used: anti-HLA-DR-PE and anti-CD14-PE (Becton-Dickinson, Erembodegem, Belgium); anti-CD1a-FITC, anti-CD83-PE and anti-CD86-PE (BD Pharmingen, Erembodegem, Belgium). Isotypic controls were mouse IgG1-PE, IgG1-FITC and IgG2a-PE (Becton-Dickinson). Flow cytometry was performed on a FACSTAR™ Plus and data were analyzed using the CELL QUEST™ software (Becton Dickinson). DCs were defined by light scatter, dead cells were gated out and fluorescence histograms were evaluated. The results of the phenotypic analysis were used as a measure of the quality of the DC culture. The unexposed, immature DCs were consistently 40-50% CD1a+, 50-60% HLA-DR+, 6-8% CD86+, 2-3% CD83+ and <5% CD14+.

Extraction of Total RNA

After the appropriate exposure times, the remaining cells were centrifuged (400 g, 10 minutes) and the supernatans was removed. Cells were lysed in RLT™ lysis buffer (Qiagen, Hilden, Germany). Total RNA was isolated using RNE-ASY™ Mini RNA isolation kits, according to the manufacturer's specifications (QiaGen). RNA was stored in RNase-free water (Qiagen) at −80° C. The RNA concentration was determined by UV-spectrophotometry and quality was visually inspected for non degradation on an agarose-gel.

RNA Amplification and cDNA Labelling

Antisense RNA amplification was performed using a modified protocol of in vitro transcription (Puskas et al. RNA amplification results in reproducible microarray data with slight ratio bias. Biotechnology (2002) 32(6):1330-1334, 1336, 1338, 1340). For the first strand cDNA synthesis, 5 µg of total RNA was mixed with 2 µg of a HPLC-purified anchored oligo-dT+T7 promoter (5'-GGCCAGTGAATTG-TAATACGACTCACTATAGGGAGGCGG-T24(ACG)-3') (SEQ ID NO: 154) (Invitrogen) in a total volume of 22.0 µl, and heated to 65° C. for 5 minutes. To this mixture, 8 µl 5× first strand buffer, 4 µl 0.1 M DTT, 3 µl 10 mM dNTP mix, and 2.5 µl (500 Units) SUPERSCRIPT™ II (all from Invitrogen) were added. The sample was incubated overnight in a Perkin-Elmer thermocycler at 42° C. To the first strand reaction mix, 83.8 µl Rnase free water, 33.4 µl 5× second strand synthesis buffer, 3.4 µl 10 mM dNTP mix, 1 µl of 10 U/µl $E. coli$ DNA ligase, 4 µl 10 U/µl $E. coli$ DNA Polymerase 1 and 1 µl 2 U/µl $E. coli$ Rnase H (all from Invitrogen) were added, and incubated at 16° C. for at least 3 hours. The synthesized double-stranded cDNA was purified with QIAQUICK™ (Qiagen) and was dried in a SPEEDVAC™.

Antisense RNA synthesis was done using the AMPLISCRIBE™ T7 high yield transcription kit (Epicentre Technologies, Madison, USA) in total volume of 20 µl according to the manufacturer's instructions. The RNA was purified by salt precipitation and was resuspended in 50 µl Rnase-free water.

Six µg of random hexamers (Invitrogen, Belgium) was added to 5 µg amplified RNA in a 22.0 µl volume and was incubated at 65° C. during 10 minutes. To this mixture, 8 µl 5× first strand buffer, 4 µl 0.1 M DTT, 1.4 µl 10 mM amino-allyl-dUTP (Sigma), 1 µl 20 mM dATP, dGTP, dCTP mix, 1.3 µl 5 mM dTTP and 2.5 µl (500 Units) SUPERSCRIPT™ II (all from Invitrogen) was added. The mixture was incubated overnight at 42° C.

RNA was hydrolyzed by adding 10 µl 1 M NaOH and 10 µl 0.5 M EDTA and by incubating for 30 minutes at 65° C. Ten µl 1 M HCl was added to neutralize the solution and the excess aa-dUTP was removed using a QiaQuick purification column. The sample was dried in a SpeedVac and resuspended in 4.5 µl 0.1 M Na2CO3 (pH 9.0). 4.5 µl CY-DYE™ ester (Amersham Pharmacia PA25001 and PA23001, the content of 1 CY-DYE™ vial was dissolved in 73 µL DMSO (Labscan, Dublin, Ireland), CY5™ was used for the exposed samples, CY3™ for the control samples) was added and incubated during 1.5 hours in the dark at room temperature. Non-incorporated Cy-dyes were removed by purification of the samples using a QiaQuick column.

Yield and incorporation of the dyes was estimated by UV-spectrophotometry. Samples were combined and 5 µl (1 µg/µl) Cot DNA, 5 µl (10 µg/µl) tRNA and 1 µl (20 µg/µl) poly-A (Sigma) DNA was added. The sample was subsequently dried in a SPEEDVAC™.

Microarray Hybridization and Washing

Microarray slides were obtained from the Vanderbilt Microarray Shared Resources Centre, Nashville, Tenn., USA. Human 11 k arrays were used, containing cDNA clones corresponding to approximately 11,000 human genes. The slides were prehybridized in 5×SSC, 1% BSA and 1% SDS during 45 minutes at 55° C. Slides were cleaned by washing in 5 changes of water, followed by washing in isopropanol. Slides were air-dried.

The dried sample was resuspended in 60 µl hybridization solution (50% formamide, 5×SSC, 0.1% SDS) and was heated in boiling water during 2 minutes. The sample was applied to the microarray slide and was transferred to a microarray hybridization chamber and was incubated overnight at 40° C. in the dark.

The coverslip was removed by plunging the slide gently in 2×SSC+0.1% SDS at 55° C. Post-hybridization washing was performed for 5 minutes at 55° C. in 1×SSC, 0.1% SDS, 3 minutes in 0.5×SSC (room temperature), two times for 3 minutes at room temperature in 0.1×SSC and rinsing 2 times in 0.1×SSC to remove traces of SDS.

Microarray Data Analysis

Slides were scanned at 532 nm and 635 nm using a Tecan LS200 scanner, (TECAN™ Grodig/Salzburg, Austria). Image analysis was performed with ARRAYPRO™ Analyzer software (MediaCybernetics, Silver Spring, Md., USA). Spot intensity was measured as mean intensity of the spot, subtracted with mean intensity of the local background of each spot. Expression of a gene on a specific spot was considered as relevant if the signal was larger than the background plus 5× the standard deviation of the background. Data were normalized using a Lowess-procedure and the CY5™/CY3™ ratios were determined.

To identify genes that were influenced significantly by exposure of CD34-DC to sensitizing chemicals the method described above was used.

As mentioned before, a list of 153 candidate sequences (see SEQ ID NO 1 to 153) were identified. The list is detailed in the Sequences Table (Table 1).

The Statistical Classification Model:

The aim of a statistical classification model is to classify any presented chemical compound into one out of two classes: $C_1$=sensitizing or $C_2$=non-sensitizing. For each chemical compound, a number of variables is measured: denote these variables as: $x_i$="expression of gene i", i= 1, . . . , n with n to be determined (further discussed below). The logarithmic fold change (LFC) may be used as input ($x_i$) to the statistical classification model, also called the "predictive model".

The design of a predictive model (optional) starts by measuring the said variables $x_i$ on a (preferably large) set of compounds of which it is a priori known whether they belong to $C_1$ or $C_2$. This collection of measurements (further referred to as the trainingset) will serve as a reference set of examples. Next, a mathematical classification model is chosen, which is subsequently optimized (trained) for these reference examples.

More precisely, the collection of gene expressions $x_i$ for a subset of genes, for instance 5 up to 10 genes, may be used as reference set examples.

Thereafter, a mathematical classification model is chosen. There are many possibilities, see below. The main differences between the models are the assumptions and complexity of the mathematical relations. Some models are discriminative in nature: they produce as an output one of the classes. Some models are probabilistic: they produce probabilities for class memberships. Some models can be analytically optimized, other more complex models need numerical optimization with the inherent uncertainty about the (non-)global nature of the optimum. In general more complex models can find more complex (non-linear) relations but need more training examples. The more straightforward models need less data and are more robust, less sensitive to instabilities.

The choice of a classification model will be data-driven and can change in time due to the nature of the growing trainingset as known to a person skilled in the art.

Some possible models are:

Linear or quadratic discriminant models

Logistic discriminant model

Tree model
Nearest neighbor model
Neural network (multi layer perceptron, radial basis)
Support vector machines The classification model is subsequently optimized (trained) for these reference examples. It means that when for a compound of the trainingset the corresponding inputs $x_i$ are presented to the model, the model should be able to choose between $C_1$ or $C_2$, with as few misclassifications as possible. This optimization step is sometimes called "supervised learning" since the class membership (sensitizing potential of the presented compounds) is known a priori.

To select the final set of n genes, one preferably starts with the most promising genes (those of group 1 or possibly group 2). As long as a gene shows discriminating power it is retained (in the trainingset), otherwise it is rejected. The trainingset (and the database) is thus a dynamic entity in time. This procedure is repeated until a set of preferably 5-10 (discriminative) genes is retained.

Next, the trainingset consisting of the $x_i$ of these n genes is used to train and evaluate the classification model. Since at this point the number of genes is small, it is possible to test different combinations of genes. The performance of a classification model is the final criterion used to retain or reject genes (and also to select exposure times and exposure concentrations). I.e. in this process a further selection of inputs takes place. If it turns out that the number of genes that left over is to small to produce a good classification model, new genes (from group 1, 2 or 3 if needed) can be included.

The construction of a classification model is thus advantageously an iterative process that will continue as the database (trainingset) grows, i.e. new compounds are included or other genes from the list in Table 1 are measured on the reference compounds.

When the model performs well on the trainingset and this set is representative for other compounds, one can assume that by generalization the found mathematical relation can be used to make predictions. It means that the model is capable to classify new compounds of which the sensitizing potential is (a priori) unknown.

It is thus possible to estimate a models capability to generalize, this can be done by means of cross-validation: the original trainingset is divided into a trainingset and a testset; after training the generalization can be measured by the models performance on the testset.

Below some examples are presented to further illustrate the invention. The examples are not intended to be limiting.

Example 1

Determination of the ACD Potential of a Specific Chemical Compound

The method as described higher for determining the candidate genes (biomarkers) can now be used in a revised form for determining the ACD sensitizing potential of a chemical compound, using the reference database constructed as disclosed hereabove.

CD34-DCs derived from cord blood are exposed to a chemical compound to be tested for allergenicity. Each CD34-DC sample is used for exposure for a predefined period of time or for a time series. At each time point, a non-exposed control sample from the same donor is also obtained. For each chemical, CD34-DCs from 3 unrelated individuals are used.

Subsequently, a microarray analyses is performed for selected time points, said microarray comprising a subset of e.g. 5 or 10 cDNA fragments corresponding to the RNA sequences represented as SED ID NO 1 to 153.

The expressions for said 10 cDNA fragments resulting from said microarray analyses are used as input for a classification test (or model) (as described above) to determine the ACD potential of said chemical compound.

Example 2

Cross-Validation of the Results Obtained by Microarray Analysis

The current microarray data base comprises 11,000 gene expressions for test and control samples from on average 3 individuals, exposed for a time series to:

| Sensitizers | Irritants |
| --- | --- |
| Nickel (Ni) | BC |
| Oxazolone (Oxa) | SDS |
| DNCB | |
| Eugenol (Eug) | |

As a test case for an explicit example, the data base will now be restricted to the exposure time of 12 hours. Further, Ni and BC will be removed from the data base and used as compounds for which the ACD potential has to be determined.

Figure 1:
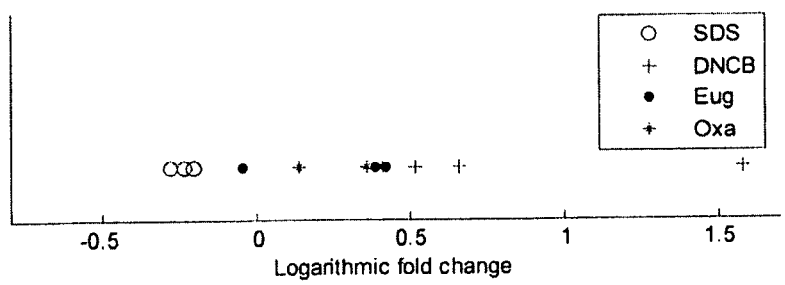
FIG. 1 shows the logarithmic fold change after an exposure time 12 hours (LFC_12), each symbol corresponds to a donor individual.

Next, from SEQ ID NO 1 to 153 consider only the gene 1 (the one corresponding to SEQ ID NO 1). For this gene, the expressions are looked up in the data base and the logarithmic fold change (LFC) is determined. The result is shown in FIG. 1.

Based on the expression data of this gene for these compounds, a very simple classification model could be defined as: "a chemical compound has ACD sensitizing potential if the LFC_12 averaged over a few individuals is larger than zero".

Figure 2:
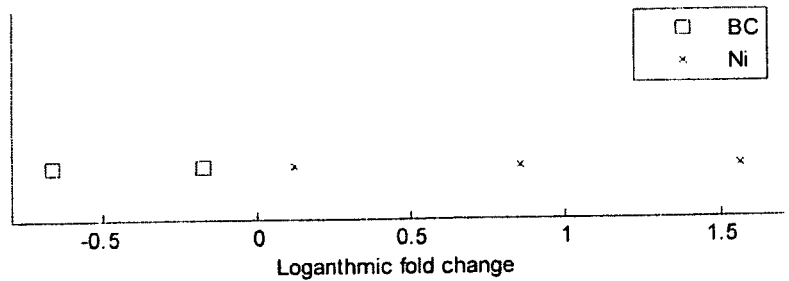
FIG. 2 represent the LFC_12 for nickel and BC, the test chemical compounds in casu, each symbol corresponds to a donor individual.

Finally, Ni and BC can be tested for their sensitizing potential. Their LFC_12 is presented in the FIG. 2.

When these data are fed into the classification statement above, one arrives at the correct conclusion that Ni has an ACD sensitizing potential and BC has not.

The approach in this example is too simple, for a robust test more genes have to be included, which calls for a classification method in a higher dimensional vector space. Possible methods hereto are linear discriminant analysis or when non-linear methods are needed neural networks and support vector machines are possible candidates.

It should be noted that the gene expressions measured in the presence of specific chemical compound are used to continuously reevaluate the quality of the reference database.

In other words, the reference database is dynamical entity in time. The trainingset is a dynamical entity, it will grow in time whenever $x_i$ are measured of a compound which is known to be (non)sensitizing. The model optimization described above has to be repeated when new data becomes available. This iterative process will continuously fine-tune the model and will serve a guidance in selecting the final genes (i.e. $x_i$) to use.

A limited number of genes can be sufficient to identify chemical allergens with sufficient confidence. Based on the number and the type of genes, many different strategies for determining the expression levels can be applied, for example some of the most commonly used procedures:

At the mRNA Level:
  Dedicated microarrays on glass, plastic or nylon membranes

Multiplex real-time RT-PCR or multiple singleplex real-time RT-PCR methods
Competitive RT-PCR methods
RNase protection assay
Northern blotting
Construction of genetic constructs of promotor sequences of the candidate gene to fluorescent molecules and transformation into relevant cell lines, followed by measuring light production At the Protein Level
On dedicated protein (micro)arrays on glass, plastic, membranes
Multiplex protein analyses by e.g. the Luminex system
Elisa
FACS analyses
Western blotting

Example 3

A Further Example Using a Prediction Model Based on a Trainingset with 4 Genes and 9 Reference Compounds RT-PCR Data Used in this Example Gene expressions $x_i$ were determined via RT-PCR for the following genes: PBEF1 (AA281932), CREM (AA464861), CXCR4 (T62636), MAX (H86558), ENC (H72122), NINJ (AA625806), CCR2 (H58254), PTGS2 (R802171AA644211), CD36 (N39161), CLTB (N39161), CLTB (N20335) and CCR7 (NM_001838).

The following 9 chemical sensitizing model compounds were used:

| Sensitizers | | Non-sensitizers | |
|---|---|---|---|
| Nickel | Nickel sulphate | DMSO | dimethylsulfoxide |
| DNCB | dinitrochlorobenzene | TBT | Tributyltin chloride |
| 2MBT | 2-mercaptobenzothiazole | Triton | tritonX-100 |
| PPD | p-phenylenediamine | | |
| DNBS | Dinitrobenzenesulfonic acid | | |
| DNFB | dinitrofluorobenzene | | |

The first 6 are known to be sensitizers and the last 3 known to be non-sensitizers. Their (non)sensitizing potential is known a priori (from in vivo tests).

Expression of every gene was measured after exposure to each of the 9 different compounds (control solvent). For each compound on average 3 different unrelated individuals were used for exposure. On average sample from 3 different individuals were used per compound. Each exposure consisted of 3 exposure times (6, 12 and 24 hours) and three different concentrations were used for each exposure experiment. Consequently, on average for each gene one has 9*3*3*3=243 LFC values (logarithmic fold change).

Since from the three concentrations tested only the highest (corresponding roughly to an EC20) induced clearly non-zero LFC values, the example is further confined to one concentration. The LFC's of the two other concentrations will be omitted: hence for each gene 81 LFC measurements were used.

Discriminating Power of Each Gene Individually

Figure 3:
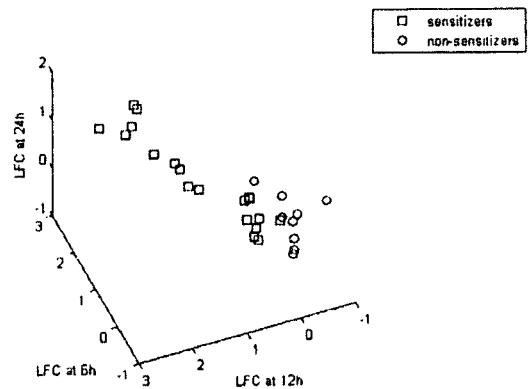
FIG. 3 shows the LFC values of PBEF1 per individual, measured after exposure to the 9 compounds, the compounds are grouped according to their sensitizing character.

To asses the discriminating power of a gene, one has to quantify how well the LFC's from the sensitizers can be distinguished from the LFC's of the non-sensitizers. The data of each gene can be represented as 27 points (9 compounds, on average 3 individuals) in a three-dimensional space (3 time points): See FIG. 3 for the PBEF1 data.

To quantify the separation of the two groups one can use e.g. a linear discriminant analysis (lda). This method determines the direction(s) in space (in our case one direction in a 3D space) in which the discrimination between the groups is maximal. By projecting all data on this direction one reduces the data to one dimension (see FIG. 4). Mathematically, this projection is a linear combination of the LFC at 6, 12 and 24 hours; this linear combination of LFC's will be called the feature value. On this feature data per gene an F-test can be performed to assess the significance (p-value) of the separation. (An F-test compares the within-group variance to the between group variance.) The result for each gene ordered by p-value is given in FIG. 4.

One can now set a threshold and only retain those genes with a p-value below it. For the current example a threshold of p=0.0001 was chosen, hence retaining NINJ, PBEF1, CCR7, CREM and MAX. Since for the gene MAX, due to technical problems the experiments with nickel were unsuccessful, this gene is further omitted.

Construction of Classification Model Based on: NINJ, PBEF1, CCR7, CREM

For each individual exposed to a compound, one now has four feature values, one for each of the considered genes. Hence, these data can be represented in a four dimensional space as a cloud of sensitizers and a cloud of non-sensitizers.

First, the dimensionality was further reduced: the data were projected onto a two-dimensional space. This makes the example visually more conceivable, but more importantly, a dimensionality reduction reduces the risk of overfitting and can improve the generalization of a classification model when the amount of training data is limited.

To this end the lda was again used to find the two dimensional subspace in which the separation between the two groups is optimal. The result is shown in FIG. 5. The variables on the two axes of this space are now a linear combination of the four feature values of the four genes. We will call the x- and y-variable respectively feature value 1 and 2. Note that these feature values are trained by the data. If e.g. some compounds are left out of the dataset, and the procedure is repeated, the resulting feature values and hence the two-dimensional representation of the data will be different.

From FIG. 5 it is clear that the sensitizers and non-sensitizers fall into two well separated groups. To construct a classification model based on this data we used a quadratic discriminant analysis. For this quadratic model, the decision boundary separating the two groups is a conic section, in this case an ellipse.

From FIG. 5 it is clear that it is not difficult to create a classification model that can separate the two groups correctly. However, since the amount of data is limited it is less obvious whether such a model will correctly classify a new compound that is not used in the optimization of the model. A first assessment of the generalization potential of the model is a cross validation.

Cross Validation of the Classification Model

First one chooses one of the 9 compounds and removes the corresponding measurements from the dataset.

Next one repeats the lda optimization and the construction of a quadratic discriminant model as described in the previous step.

Next the data of the removed compound are fed into the classification model and used to predict the class to which the compound belongs.

The result of this exercise for each of the 9 compounds is shown in FIG. 6.

From FIG. 6 one reads that the model classifies TBT, triton and DMSO as non-sensitizers and the other compounds as sensitizers. This is correct. Moreover, for every compound there is full agreement between the individuals (on average 3): all test-points fall into the same class.

Hence, for the compounds under consideration a combination of the LFC's of genes NINJ, PBEF1, CCR7 and CREM measured after exposure (concentration of EC20) for 6, 12 and 24 h is sufficient to make a good classification model. Consequently, a first test to predict the sensitizing potential of a new compound can be constructed and it would require as input data the mentioned LFC measurements after the mentioned exposure at the mentioned concentration to this new compound.

To increase the accuracy and reliability of the model, one should test (preferably on more individuals) more compounds of which one know a priori the sensitizing potential. Whenever such extra data become available a procedure analogous to this example can be performed to update the classification model and refine the test. This may lead to the use of other or a different number of genes. However it is expected that 5 to 10 genes, selectively chosen from the list mentioned in Table 1 should suffice to construct a good model.

TABLE 1

Sequences Table. First column: SEQ ID No. Second column: corresponding mRNA sequence. For the 3 different groups, see explanation in the text.

Group 1

```
01 GCTGCCGCGCCCCGCCCTTTCTCGGCCCCCGGAGGGTGACGGGGTGAAGGCGGGGGAACCGAGGTGGGGAGTCCGCCAGAGCTCCC
   AGACTGCGAGCACGCGAGCCGCCGCAGCCGTCACCCGCGCCGCGTCACGGCTCCCGGGCCCGCCCTCCTCTGACCCCTCCCCTCTC
   TCCGTTTCCCCCTCTCCCCCTCCTCCGCCGACCGAGCAGTGACTTAAGCAACGGAGCGCGGTGAAGCTCATTTTTCTCCTTCCTCG
   CAGCCGCGCCAGGGAGCTCGCGGCGCGCGGCCCCTGTCCTCCGGCCCGAGATGAATCCTGCGGCAGAAGCCGAGTTCAACATCCTC
   CTGGCCACCGACTCCTACAAGGTTACTCACTATAAACAATATCCACCCAACACAAGCAAAGTTTATTCCTACTTTGAATGCCGTGA
   AAAGAAGACAGAAAACTCCAAATTAAGGAAGGTGAAATATGAGGAAACAGTATTTTATGGGTTGCAGTACATTCTTAATAAGTACT
   TAAAAGGTAAAGTAGTAACCAAAGAGAAAATCCAGGAAGCCAAAGATGTCTACAAAGAACATTTCCAAGATGATGTCTTTAATGAA
   AAGGGATGGAACTACATTCTTGAGAAGTATGATGGGCATCTTCCAATAGAAATAAAAGCTGTTCCTGAGGGCTTTGTCATTCCCAG
   AGGAAATGTTCTCTTCACGGTGGAAAACACAGATCCAGAGTGTTACTGGCTTACAAATTGGATTGAGACTATTCTTGTTCAGTCCT
   GGTATCCAATCACAGTGGCCACAAATTCTAGAGAGCAGAAGAAAATATTGGCCAAATATTTGTTAGAAACTTCTGGTAACTTAGAT
   GGTCTGGAATACAAGTTACATGATTTTGGCTACAGAGGAGTCTCTTCCCAAGAGACTGCTGGCATAGGAGCATCTGCTCACTTGGT
   TAACTTCAAAGGAACAGATACAGTAGCAGGACTTGCTCTAATTAAAAAATATTATGGAACGAAAGATCCTGTTCCAGGCTATTCTG
   TTCCAGCAGCAGAACACAGTACCATAACAGCTTGGGGGAAAGACCATGAAAAAGATGCTTTTGAACATATTGTAACACAGTTTTCA
   TCAGTGCCTGTATCTGTGGTCAGCGATAGCTATGACATTTATAATGCGTGTGAGAAAATATGGGGTGAAGATCTAAGACATTTAAT
   AGTATCAAGAAGTACACAGGCACCACTAATAATCAGACCTGATTCTGGAAACCCTCTTGACACTGTGTTAAAGGTTTTGGAGATTT
   TAGGTAAGAAGTTTCCTGTTACTGAGAACTCAAAGGGTTACAAGTTGCTGCCACCTTATCTTAGAGTTATTCAAGGGGATGGAGTA
   GATATTAATACCTTACAAGAGATTGTAGAAGGCATGAAACAAAAAATGTGGAGTATTGAAAATATTGCCTTCGGTTCTGGTGGAGG
   TTTGCTACAGAAGTTGACAAGAGATCTCTTGAATTGTTCCTTCAAGTGTAGCTATGTTGTAACTAATGGCCTTGGGATTAACGTCT
   TCAAGGACCCAGTTGCTGATCCCAACAAAAGGTCCAAAAAGGGCCGATTATCTTTACATAGGACGCCAGCAGGGAATTTTGTTACA
   CTGGAGGAAGGAAAAGGAGACCTTGAGGAATATGGTCAGGATCTTCTCCATACTGTCTTCAAGAATGGCAAGGTGACAAAAAGCTA
   TTCATTTGATGAAATAAGAAAAAATGCACAGCTGAATATTGAACTGGAAGCAGCACATCATTAGGCTTTATGACTGGGTGTGTGTT
   GTGTGTATGTAATACATAATGTTTATTGTACAGATGTGTGGGGTTTGTGTTTTATGATACATTACAGCCAAATTATTTGTTGGTTT
   ATGGACATACTGCCCTTTCATTTTTTTCTTTTCCAGTGTTTAGGTGATCTCAAATTAGGAAATGCATTTAACCATGTAAAAGATG
   AGTGCTAAAGTAAGCTTTTTAGGGCCCTTTGCCAATAGGTAGTCATTCAATCTGGTATTGATCTTTTCACAAATAACAGAACTGAG
   AAACTTTTATATATAACTGATGATCACATAAAACAGATTTGCATAAAATTACCATGATTGCTTTATGTTTATATTTAACTTGTATT
   TTTGTACAAACAAGATTGTGTAAGATATATTTGAAGTTTCAGATGATTTAACAGTCTTTCCAACTTTTCATGATTTTTATGAGCACA
   GACTTTCAAGAAAATACTTGAAAATAAATTACATTGCCTTTTGTCCATTAATCAGCAAATAAAACATGGCCTTAACAAAGTTGTTT
   GTGTTATTGTACAATTTGAAAATTATGTCGGGACATACCCTATAGAATTACTAACCTTACTGCCCCTTGTAGAATATGTATTAATC
   ATTCTACATTAAAGAAAATAATGGTTCTTACTGGAATGTCTAGGCACTGTACAGTTATTATATATCTTGGTTGTTGTATTGTACCA
   GTGAAATGCCAAATTTGAAAGGCCTGTACTGCAATTTTATATGTCAGAGATTGCCTGTGGCTCTAATATGCACCTCAAGATTTTAA
   GGAGATAATGTTTTTAGAGAGAATTTCTGCTTCCACTATAGAATATATACATAAATGTAAAATACTTACAAAAGTGGAAGTAGTGT
   ATTTTAAAGTAATTACACTTCTGAATTTATTTTTCATATTCTATAGTTGGTATGACTTAAATGAATTACTGGAGTGGGTAGTGAGT
   GTACTTAAATGTTTCAATTCTGTTATATTTTTTATTAAGTTTTTAAAAAATTAAATTGGATATTAAATTGTATGGACATCATTTAT
   TAATTTTAAACTGAATGCCCTCAATAAGTAATACTGAAGCACATTCTTAAATGAAGATAAATTATCTCCAATGAAAAGCATGACAT
   GTGTTTCAATAGAAGAATCTTAAGTTGGCTAAATTCAAAGTGCTTGACATCAAATGTTCTAGAGTGATTAGCTACTAGATTCTGA
   ATCATACATCACATCTGACTAGAGACCAGTTTCTTTCGAATGATTCTTTTATGTATGTAGATCTGTTCTTCTGAGGCAGCGGTTGG
   CCAACTATAGCCCAAAGGCCAAATTTGGACTTCTTTTTATAAATGCAGATTGTCTATGGCTGCTTTCCCACTACTCCAGCCTAAGG
   TAAACAGCTGCAATAGAAGCCAAATGAGAATCGCAAAGCCCAAAATGTTTATTAACCTGCCCTTTACACAAAATTACACAAAAAGT
   TTCCTGATCTCTGTTCTAAGAAAAGGAGTGTGCCTTGCATTTAAAAGGAAATGTTGGTTTCTAGGGAAGGGAGGAGGCTAAATAAT
   TGATACGGAATTTTCCTCTTTTGTCTTCTTTTTTCTCACTTAAGAATCCGATACTGGAAGACTGATTTAGAAAAGTTTTTAACATG
   ACATTAAATGTGAAATTTTAAAAATTGAAAAGCCATAAATCATCTGTTTTAAATAGTTACATGAGAAAATGATCACTAGAATAACC
   TAATTAGAAGTGTTATCTTCATTAAATGTTTTTTGTAAGTGGTATTAGAAAGAATATGTTTTTCAGATGGTTCTTTAAACATGTAG
   TGAGAACAATAAGCATTATTCACTTTTAGTAAGTCTTCTGTAATCCATGATATAAAATAATTTTAAAATGATTTTTTAATGTATTT
   GAGTAAAGATGAGTAGTATTAAGAAAAACACACATTTCTTCACAAAATGTGCTAAGGGGCGTGTAAAGAATCAAAAGAAACTATTA
   CCAATAATAGTTTTGATAATCACCCATAATTTTGTGTTTAAACATTGAAATTATAGTACAGACAGTATTCTCTGTGTTCTGTGAAT
   TTCAGCAGCTTCAGAATAGAGTTTAATTTAGAAATTTGCAGTGAAAAAAGCTATCTCTTTGTTCACAACCATAAATCAGGAGATGG
   AGATTAATTCTATTGGCTCTTAGTCACTTGGAACTGATTAATTCTGACTTTCTGTCACTAAGCACTTGGTATTTGGCCATCTCCAT
   TCTGAGCACCAAACGGTTAACACGAATGTCCACTAGAACTCGTCTGTGTGTCACCCTTAAATCAGTCTAAATCTTCCAGACAAAAG
   CAAATGGCATTTATGATTTAAGTCATTAGATTTTCAACTGACATTAATTAATCCCTCTTGATTGATTATATCATCAAGTATTTAT
   ATCTTAAATAGGAGGTAGGATTTCTGTGTTAAGACTCTTATTTGTACCCTATAATTAAAGTAAAATGTTTTTTATGAGTATCCCTT
   GTTTTCCCTTCTTAAATTGTTTATCAAACAATTTTTATAATGAAATCTATCTTGGAAATTAAAAAGAATAGCAAAAAATGGCAAGGTATTTAT
   TGTTCTGTTTGCCATAATTTAGAACTCACACTTAAGTATTTTGTAGTTTTACATTCCTTTTTAACCCATTCAGTGGAGAATGTCAG
   CTTTTCTCCCAAGTTGTATGTTAAGTCTATTCTAATATGTACTCAACATCAAGTTATAAACATGTAATAAACATGGAAATAAAGTT
   TAGCTCTATTAGTGAAGTGTTAAAAAAAAAAAAAAA

02 GACCCGCCTGCCTCCTCGCGAACTTGGGACGAGTTGGAAAATCCTCCCTGAGAGAGCCGTGCGGCTCAGGGGAGCGGTTTAACTCG
   GAAAAGGAAAAGGAATCCAGAGATAAATAAAGAAACAGGAAAGGAGGAAAGCATTGATTACAAATATCTTAACAATGAGCAAAT
   GTGCAAGGAAAAAATATATTAAGACAAATCCAAGACAAATGACCATGGAAACAGTTGAATCCCAGCATGATGGAAGTATAACAGCT
   TCTTTGACAGAGAGCAAGTCTGCTCATGTGCAGACTCAGACTGGCCAAAATTCAATCCCTGCTTTAGCTCAGGTAGCAGCAATTGC
   AGAGACAGATGAATCTGCAGAATCAGAAGGTGTAATTGATTCTCATAAACGTAGAGAAATCCTTTCACGAAGACCCTCTTATAGGA
```

TABLE 1-continued

Sequences Table. First column: SEQ ID No. Second column: corresponding mRNA sequence. For the 3 different groups, see explanation in the text.

```
   AAATACTGAATGAACTGTCCTCTGATGTGCCTGGTGTTCCCAAGATTGAAGAAGAGAGATCAGAGGAAGAAGGAACACCACCTAGT
   ATTGCTACCATGGCAGTACCAACTAGCATATATCAGACTAGCACGGGGCAATACATTGCTATAGCCCAAGGTGGAACAATCCGAT
   TTCTAACCCAGGATCTGATGGTGTTCAGGGACTGCAGGCATTAACAATGACAAATTCAGGAGCTCCTCCACCAGGTGCTACAATTG
   TACAGTACGCAGCACAATCAGCTGATGGCACACAGCAGTTCTTTGTCCCAGGCAGCCAGGTTGTTGTTCAAGCTGCCACTGGTGAC
   ATGCCAACTTACCAGATCCGAGCTCCTACTGCTGCTTTGCCACAGGGAGTGGTGATGGCTGCATCGCCCGGAAGTTTGCACAGTCC
   CCAGCAGCTGGCAGAAGAAGCAACACGCAAACGAGAGCTGAGGCTAATGAAAAACAGGGAAGCTGCCAAAGAATGTCGACGTCGAA
   AGAAAGAATATGTAAAATGTCTGGAGAGCCGAGTTGCAGTGCTGGAAGTCCAGAACAAGAAGCTTATAGAGGAACTTGAAACCTTG
   AAAGACATTTGTTCTCCCAAAACAGATTACTAGAAATATTTAACTATGAACTGAAGGCAGCATGTATAGTTGCTTTTGAAGGAATA
   CAATATATAGCTGGCAAGAATGGTGGCTTCTTTTCTTTGTATCATTCATCTTCTTCTTTAATCACTTAACATTCCTAAAATGCTTC
   ACTGTACGTAGTTAAGTCGTAGCTATAACTTCAAATTTTTTAAAAGAGACAAACTGTAAAAAATGTGTGTATTCTTAAAATGCAAT
   ATTTGTAAGGCTTGTTCCAATGCCACATACTTGCAGCTCCCATTCTATGTGTCATCAATAGTGTCCTATGCAATAAAATTATTTGC
   AGGTCTTTAAATCATTTTAGGAAAGGATGATCAAAAATAATGCATCCAGCAGTACAATAAAAGTAAACCACAAAAAAATACCTCAG
   GAAAGAATAGAAAGAAAGTCTATCTAATGACATGCCTATATGAGAAGAATAGCCTAGATATGAATATATGGCATTTGCAGATTTTT
   ATATTAGTTGCTTTGTTAAAAAAAAAAAGATTGTATTGCTGTCCTTGAATGCCATAGTCAAAGAGAGTTTTTAATAGAACCATGTT
   GGTTGCACTTTGTAGTGTTTGGTGCTCATTTAAATATCTGAACATTTACTACAGTTTTTAACTCTACTGTGTAATATAAAAGATCT
   TGCAGAAGTTCTTAGTGTTGGTTTAATATTACCTAATGAAAGTGATGACATATTTTTTATATCTGGAATGAGCCTGTTGGGATCGC
   ATTGCATACCTTCGGGGTACAAGTCAGTTTCTACACTGGGTGCTGATCCTTGCACGCGCCCTTTCTACCATCTCACGGTGGGGATG
   GCCGCAGGGCTGTGCACCCAGAAGAAGATGGCTGTTAGCGTTTCGGCCTTCATAATGGCCTGAGACTTTCTTTCTGTAGGTGGTCT
   GGAGCTGTCCGGCTGGTGGCCCCCTATTTTGCCATTTAGCGAACAACCACAGGAATTTTAAAAACAAAAACATCCCAAGATTTTTT
   CATTTCAAAATGCTTCAAAGTCCACATTAGATCAGATACTCCGCTGTCGGCACATTCAGCTGAGGTTCATTACAATCGAGACTGCA
   ATGTGATCTATGTTTCATCTTGTTTTTATAATAAAAAGCTTCAGGGAACAAGCCCAAAGCCCTCACCACAAAAA

03 GTGGGGTGGGGTGGGGCTGGGGGCTTGTCGCCCTTTCAGGCTCCACCCTTTGCGGAGATTATAAATAGTCATGATCCCAGCGAGAC
   CCAGAGATGCCTGTAATGGTGAGACTTTGGATCCTTCCTGAGGACGTGGAGAAAACTTTCTGCTGAGAAGGACATTTTGAAGGTTT
   TGTTGGCTGAAAAAGCTGTTTCTGGAATCACCCCTAGATCTTTCTTGAAGACTTGAATTAGATTACAGCGATGGGGACACAGAAGG
   TCACCCCAGCTCTGATATTTGCCATCACAGTTGCTACAATCGGCTCTTTCCAATTTGGCTACAACACTGGGGTCATCAATGCTCCT
   GAGAAGATCATAAAGGAATTTATCAATAAAACTTTGACGGACAAGGGAAATGCCCCACCCTCTGAGGTGCTGCTCACGTCTCTCTG
   GTCCTTGTCTGTGGCCATATTTTCCGTCGGGGGTATGATCGGCTCCTTTTCCGTCGGACTCTTCGTCAACCGCTTTGGCAGGCGCA
   ATTCAATGCTGATTGTCAACCTGTTGGCTGTCACTGGTGGCTGCTTTATGGGACTGTGTAAAGTAGCTAAGTCGGTTGAAATGCTG
   ATCCTGGGTCGCTTGGTTATTGGCCTCTTCTGCGGACTCTGCACAGGTTTTGTGCCCATGTACATTGGAGAGATCTCGCCTACTGC
   CCTGCGGGGTGCCTTTGGCACTCTCAACCAGCTGGGCATCGTTGTTGGAATTCTGGTGGCCCAGATCTTTGGTCTGGAATTCATCC
   TTGGGTCTGAAGAGCTATGGCCGCTGCTACTGGGTTTTACCATCCTTCCTGCTATCCTACAAAGTGCAGCCCTTCCATTTTGCCCT
   GAAAGTCCCAGATTTTTGCTCATTAACAGAAAAGAAGAGGAGAATGCTAAGCAGATCCTCCAGCCGGTTGTGGGGCACCCAGGATGT
   ATCCCAAGACATCCAGGAGATGAAAGATGAGAGTGCAGGATGTCACAAGAAAAGCAAGTCACCGTGCTAGAGCTCTTTAGAGTGT
   CCAGCTACCGACAGCCCATCATCATTTCCATTGTGCTCCAGCTCTCTCAGCAGCTCTCTGGGATCAATGCTGTGTTCTATTACTCA
   ACAGGGAATCTTCAAGGATGCAGGTGTTCAAGAGCCCATCTATGCCACCATCGGCGCGGGTGTGGTTAATACTATCTTCACTGTAGT
   TTCTCTATTTCTGGTGGAAAGGGCAGGAAGAAGGACTCTGCATATGATAGGCCTTGGAGGGATGGCTTTTTGTTCCACGCTCATGA
   CTGTTTCTTTGTTATTAAAGGATAACTATAATGGGATGAGCTTTTGTCTGTATTGGGGCTATCTTGGTCTTTGTAGCCTTCTTTGAA
   ATTGGACCAGGCCCCATTCCCTGGTTTATTGTGGCCGAACTCTTCAGCCAGGGCCCCGCCCAGCTGCGATGGCAGTGGCCGGCTG
   CTCCAACTGGACCTCCAACTTCCTAGTCGGATTGCTCTTCCCCTCCGCTGCTCACTATTTAGGAGCCTACGTTTTATTATCTTCA
   CCGGCTTCCTCATTACCTTCTTGGCTTTTACCTTCTTCAAAGTCCCTGAGACCCGTGGCAGGACTTTTGAGGATATCACACGGGCC
   TTTGAAGGGCAGGCACACGGTGCAGATAGATCTGGAAAGGACGGCGTCATGAGAATGGCATCAGAGCTGCTAAGGAGACCAC
   CACCAATGTCTAAGTCGTGCCTCCTTCCACCTCCCTCCCGGCATGGGAAAGCCACCTCTCCCTCAACAAGGGAGAGACCTCATCAG
   GATGAACCCAGGACGCTTCTGAATGCTGCTACTTAATTCCTTTCTCATCCCACGCACTCCATGAGCACCCCAAGGCTGCGGTTTGT
   TGGATCTTCAATGGCTTTTTAAATTTTATTTCCTGGACATCCTCTTCTGCTTAGGAGAGACCGAGTGAACCTACCTTCATTTCAGG
   AGGGATTGGCCGCTTGGCACATGACAACTTTGCCAGCTTTTCCTCCCTTGGGTTCTGATATTGCCGCACTAGGGGATATAGGAGAG
   GAAAAGTAAGGTGCAGTTCCCCCAACCTCAGACTTACCAGGAAGCAGATACATATGAGTGTGGAAGCCGGAGGGTGTTTATGTAAG
   AGCACCTTCCTCACTTCCATACAGCTCTACGTGGCAAATTAACTTGAGTTTTATTTATTTTTATCCTCTGGTTTAATTACATAATTT
   TTTTTTTTTTACTTTAAGTTTCAGGATACATGTGCCGAATGTGCAGGTTTGTTACATAGGTATATATATGCCATGATGGAAATATT
   TATTTTTTTAAGCGTAATTTTGCCAAATAATAAAAACAGAAGGAAATTGCAGATTAGAGGGGAGGTGTTTAAAGAGAGGTTATAGAGT
   AGAAGATTTGATGCTGGAGAGGTTAAGGTGCAATAAGAATTTAGGGAGAAATGTTGTTCATTATTGGAGGGTAAATGATGTGGTGC
   CTGAGGTCTGTACGTTACCTCTTAACAATTTCTGTCCTTCAGATGGAAACTCTTTAACTTCTCGTAAAAGTCATATACCTATATAA
   TAAAGCTACTGATTTCCTTGGAGCTTTTTCTTTAAGATAATAGTTTACATGTAGTAGTACTTGAAATCTAGGATTATTAACTAAT
   ATGGGCATTGTAGTTAATGATGGTTGATGGGTTCTAATTTTGGAGTCCAGGGAAGAGAAAGTGATTTCTAGAAAGCCTGTTC
   CCCTCACTGGATGAAATAACTCCTTCTTGTAGTAGTCTCATTACTTTTGAAGTAATCCCGCCACCTATCTCGTGGGAGAGCCATCC
   AAATAAGAAACCTAAAATAATTGGTTCTTGGTAGAGATTCATTATTTTTCCACTTTGTTCTTTAGGAGATTTTAGGTGTTGATTTT
   CTGTTGTATTTTAACTCATACCTTTAAAGGAATTCCCCAAAGAATGTTTATAGCAAACTTGGAATTTGTAACCTCAGCTCTGGGAG
   AGGATTTTTTCTGAGCGATTATTATCTAAAGTGTGTTGTTGCTTTAGGCTCACGGCACGCTTGCGTATGTCTGTTACCATGTCAC
   TGTGGTCCTATGCCGAATGCCCTCAGGGGACTTGAATCTTTCCAATAAACCAGGTTTAGCACAGTATGAGTCAATGTGCAGTGTAGC
   CCACACTTGAGAGGATGAATGTATGTGCACTGTCACTTTGCTCTGGGTGGAAGTACGTTATTGTTGACTTATTTTCTCTGTGTTTG
   TTCCTACAGCCCCTTTTTCATATGTTGCTCAGTCTCCCTTTCCCTTCTTGGTGCTTACACATCTCAGACCCTTTAGCCAAACCCTT
   GTCAGTGACAGTATTTTGGTTCTTAGTTCTCACTGTTCCCTCTGCTCCTGGAGCCTTTGAATAAAAATGCACGTAGCTGAGGCCGG
   ATGCGGTGGCTCACGCCTGTAATCCCAGCACTTTGGGAGGCCTAGGCGGGCGGTCAGGGGTTCAGGACCAGCCTGGCCAACATCGT
   GAAACCCTGTCTCTACTAAAAATGCAAAATTAGCCGGGCGTGGTGGCGGGCGCCTGTAATCCCAGCTACTTGGGAAGCTGAGGCG
   GGAGAATCATGTGAACCCGGGACGCAGGGGTTGCAGTGAGCGGAGATCGCATCATTGCACTCTAGCCTGGGCCACAGGGCGAGACT
   CCGTCTCAAAAAAAAAAAATGCACATAGCTATCGAGTGTGCTTTAGCTTGAAAAGGTGACCTTGCAACTTCATGTCAACTTTCTG
   GCTCCTCAAACAGTAGGTTGGCAGTAAGGCAGGGTCCCATTTCTCACTGAGAAGATTGTGAATATTTCCATATGGATTTTCTATTG
   TTACTCTGGTTCTTTGTTTTAAAATAAAAATTCTGAATGTACACG

04 GTTGTACTTTTAGCTTCCCCCATCCTGCAAGGCACTCAACCATGTGCTAGCTGGAGTGATCTTTATTCACAATGTCTTTACAAAG
   GCTCCTGCAACACAGCAGCAATGGCAATTTGGCGGACTTCTGCGCTGGGCCAGCGTATAGCTCTTACTCCACACTCACCGGCAGCC
   TTACGATGGACGATAATAGAAGGATTCAAATGCTAGCAGACACGGTGGCTACTCTGCCTCGGGGACGAAAGCAGCTTGCTTTGACC
   AGATCAAGTTCTTTAAGTGACTTTTCCTGGTCTCAAAGAAAGCTTGTTACTGTGGAGAAGCAGGATAATGAAACATTTGGATTTGA
   AATTCAGTCTTACAGGCCCCAGAATCAGAATGCCTGCTCCTCGGAAATGTTCACTTTGATATGCAAAATACAGGAGGACAGCCCAG
   CTCACTGTGCTGGCCTGCAAGCTGGTGATGTCCTTGCAAATATCAATGGTGTGAGCACAGAAGGTTTTACCTACAAACAAGTCGTT
   GACCTGATCAGATCGTCCGGAAACCTGCTAACGATAGAGACTCTTAATGGAACAATGATTCTGAAAAGAACGGAGCTTGAAGCAAA
```

TABLE 1-continued

Sequences Table. First column: SEQ ID No. Second
column: corresponding mRNA sequence. For the 3 different
groups, see explanation in the text.

```
   GCTGCAGGTTTTAAAGCAAACTTTGAAACAAAAATGGGTGGAGTACAGATCTCTGCAGTTACAGGAACATCGTCTGCTTCATGGTG
   ATGCAGCTAATTGCCCCAGTTTGGAAAACATGGACTTGGATGAATTGTCTTTGTTTGGACCCCTGCCTGGGCCAGGCCCAGCCCTT
   GTGGACCGGAATCGATTATCCAGTGAGAGCAGCTGTAAGAGCTGGCTGAGCTCCATGACGATGGACAGTGAAGATGGCTACCAGAC
   GTGTGTGTCTGAGGACTCCAGCAGGGGTGCCTTCAGTCGGCAGACGAGTACAGATGATGAGTGCTTTATCCCCAAGGAGGGGGATG
   ATTTTCTGAGGAGGTCATCTTCAAGGAGGAACCGGAGCATCAGTAACACCAGCAGCGGATCCATGTCTCCCTTGTGGGAGGGCAAC
   TTATCAAGCATGTTTGGGACCCTGCCCCGGAAGAGCAGAAAGGGAAGTGTCCGAAAGCAACTCTTGAAATTTATCCCTGGCCTTCA
   TCGTGCTGTGGAAGAGGAAGAAAGTCGCTTTTGACGGATTGTGGTGTCCTTTCAAATTAGCTTATTTCACAAATATCTCTAGACTC
   ACCCAGATCCCAGCTTGGTGGGAAAGTGCAGAAGAATTGCAAAACTGACATCCCATTTCACAGCAATAGTGACGTTTATTTAAATT
   GTTGTGTTATAGTTTATGCTTCTTAAATCATTTTTCAACCTAAACAGCCAATTTCTAAGCAGACAGGAAAACTAAATAATAAGTTA
   ATTAATATAACAAAGATGCAGGTTCCTGCTCATTCCAGTAATGTCTTTGAAAGCAAAACTAATATTTATTTTCTAGATTATCCCTG
   TGAATAATTGAGAACTTTTTGGAGTCAAGTATGAATAAAGGTGTGGCAGATATAATAATCTGGACTATTTTTTATAGGATAATTG
   CTGGGTTATAAAATCTTAGGTTTGCTTATGCCCAGTAGCTCCTGCGGAGGCTTAATAATAGGCAATTTTGAATTTGTTCAAACCTG
   TAATGGCTTGTAAACAAAGATGACCATCAGCTGTTTCTCACATCTATAGTGACAAGACCCAAGTCGGGAAGTATAAGATTTAATAGGAGG
   GGTTAAGGTTCATGAGAACCATGGAAAGATGTGGTCTGAGATGGGTGCTGCAAAGATCATAATAAAGTCATTTTTATAGACAGTCT
   AAACAAAATGGGTGGGGATGTCATGTTTTTTGCCCAATTCAGCTTTTGTTCTGCCTGAACATTAATGGCAAGTCTAGAACTCTCCG
   AATCCTACAGCTTTGTAATTTTTTTCTACAAATGTCTAACATCCAAACTGAGGGTTGGGAAAAGGACTTCCCTCCTGTAGTTTT
   TTTCATATTACTTCTCACTTTATATCTTATATTCTAAATAGCTATCACCTCAGCAGTCTTTTGCCTATTGGTTATGTTAGTATCAC
   ATTACTTCTAGCCTTTCAATTACTCCATGTTTTATTTAATATCCATTGAAGTCTATGAATTCTCTGTTCTGGTGGCACAGCTATTC
   ATAACCTATATTCTAGAGTAGACAATCTGGACTATGTAATAAATAGTCTGCTGATTTAAAAAAAAAAAAAAAAAAAAAAAAAAA
   AAAAAAAAAAAAAAAAAAAAAAAAAAAAAAAAAAAAAAAAAAAA

05 GCCATTACCAATCGCGAAACCGCGCCGGCGGCGGCGGCGGCGGCGGAGGAGGAGAAAGGAAAGAGGAAGGGGGAGCGGCGAGA
   GGCGGAGACGGAGCCCGACAGGGGCGGCACCACGGCACGAGCCCCGCACAGTCCAGTGTGAGGGGAGCGGCGCTAAGAGCAGGCGA
   CGCCGCCGCCGCCACCACCACCGCCATAGATACACTCTCATCCTACGGGCCACGCCTGGGCCTTGCTGCCAGGAAGCTTCGGCCCC
   GCAGCTCGGCTTGCTGCGGTCTCAGGTTTCTTTTACCTCCAGAAAGAAGAATATTGGCCCCTTGAATTCTGGAAGTTCATTGAAGAG
   TCTGAAATTAGGGACTTATTTCAAATTTGGACATGGCTAGTCGAGGCGCAACAAGACCCAACGGGCCAAATACTGGAAATAAAATA
   TGCCAGTTCAAACTAGTACTTCTGGGAGAGTCCGCTGTTGGCAAATCAAGCCTAGTGCTTCGTTTTGTGAAAGGCCAATTTCATGA
   ATTTCAAGAGAGTACCATTGGGGCTGCTTTTCTAACCCAAACTGTATGTCTTGATGACACTACAGTAAAGTTTGAAATATGGGATA
   CAGCTGGTCAAGAACGATACCATAGCCTAGCACCAATGTACTACAGAGGAGCACAAGCAGCCATAGTTGTATATGATATCACAAAT
   GAGGAGTCCTTTGCAAGAGCAAAAATTGGGTTAAAGAACTTCAGAGGCAAGCAAGTCCTAACATTGTAATAGCTTTATCGGGAAA
   CAAGGCCGACCTAGCAAATAAAAGAGCAGTAGATTTCCAGGAAGCCACAGTCCTATGCAGGACAATAGTTTATTATTCATGGAGA
   CATCCGCTAAAACATCAATGAATGTAAATGAAATATTCATGGCAATAGCTAAAAAATTGCCAAAGAATGAACCACAAAATCCAGGA
   GCAAATTCTGCCAGAGGAAGAGGAGTAGACCTTACCGAACCCACACAACCAACCAGGAATCAGTGTTGTAGTAACTAAACCTCTAG
   TTTGAACTAGCTGGAATAGTCTTCTGCTTCCTAAATGTTAATAACAATGGAATTGGAGCATTTAACCAGCCCAGTATGACTTCCAA
   AAGAAGAGACTTATGATAGAGTCAAGTTTCTAATACAGAATTATTTTAAGTGTTTTGAACTTAATTTTTAATAACATGCATGGGTC
   CCTCTCACTAATGTTTCAACAATAGGGAAAAATGAGAACTATGTGGACACTTGTTTCATTGGAAGGTTAGGGGGAATAATTTCTCA
   TCACTAGGAATATAGACAAATGACTGTCTGGGCCCACACAGTTAACCAGCCCATTTCTCCACACTGGTACAGTAGTCACCTGTGAA
   AAAAAAAATTGGAACTTACTAATTTGGGCTTTTCAAAAACATTCTTTGTTTAGAAGGAGATTCTAAAGTTATTTATGATGCTTAG
   CCATAGTATTCAGGCAAATGTTCATTTCTCCTGGTACCTGTATTTAAAATGTACATTCCACATTTTAATAAATTAACCACAAGAA
   ATAATCCCACATATACAAGGTCAGGGGTGGGAAGAGTATTAATGGTATCTTAATTATACCCAGTCTGGTTTTTTTTTAAATGGG
   GTAAAAATCAAATGCAACCCCATCTTGTTTTAGGAATTTTGAAGAATTAAATGCACTTAATGGTCAGTGTTCCTTTCAAACAT
   GTGAGTTCTTTAACAAAAATGAAATAAACCAGGTGTCTGTGATTTCTAATTAATCACCGCTGGCCATTACACAGGTTTTGTTGTTT
   GGGGTGGGAGGGGGCTTTTGTTCCCTTTTGACATAATATAGTCAATGCACTAACAATTATGTATATTCAAACTTGATTATTTTAA
   ATTCGATCTTCAGCTGTACTGTAAATAGGGTACTGCATTGTAGTCTCCATATCTGTATTACTTTTCTGTAATATTTAAGAGTTGCT
   TAAAAGCATACAAAATGTACTGTTACTAAAACAGCTAATTATTTCTCTCCCCCTTTGACAGGAAGGGGCTTCAGTTGTTCCTCC
   ATGGCTAGAACCATAATAAACAATGTACCCGTAATTTGTAACATAAAGTATTGCAATATGTTAGTAACAATCTTGCAGCCTTCCTT
   TCCAAAGTTCATTTTATTTTGATCAGTTCAGTATATTGCACTAATTATTTTAGGTATTTTCATTATATGAAAGCTACCATGTGTCA
   GAGATGATTTAATCTATTTAAGTGTTGGACTGCTAGGAGAACTTGTACATTTATGATAATGCAGAATTAGGAAAACGGTTCACCAG
   TGTTTAGTTTTATATTGAGGTGCTCAGGTT

06 TTTTTTTTCTTCCCTCTAGTGGGCGGGGCAGAGGAGTTAGCCAAGATGTGACTTTGAAACCCTCAGCGTCTCAGTGCCCTTTTGTT
   CTAAACAAAGAATTTTGTAATTGGTTCTACCAAAGAAGGATATAATGAAGTCACTATGGGAAAAGATGGGGAGGAGAGTTGTAGGA
   TTCTACATTAATTCTCTTGTGCCCTTAGCCCACTACTTCAGAATTTCCTGAAGAAAGCAAGCCTGAATTGGTTTTTTAAATTGCTT
   TAAAAATTTTTTTTAACTGGGTTAATGCTTGCTGAATTGGAAGTGAATGTCCATTCCTTTGCCTCTTTTGCAGATATACACTTCAG
   ATAACTACACCGAGGAAATGGGCTCAGGGGACTATGACTCCATGAAGGAACCCTGTTTCCGTGAAGAAAATGCTAATTTCAATAAA
   ATCTTCCTGCCCACCATCTACTCCATCATCTTCTTAACTGGCATTGTGGGCAATGGATTGGTCATCCTGGTCATGGGTTACCAGAA
   GAACTGAGAAGCATGACGGACAAGTACAGGCTGCACCTGTCAGTGGCCGACCTCCTCTTTGTCATCACGCTTCCCTTCTGGGCAG
   TTGATGCCGTGGCAAACTGGTACTTTGGGAACTTCCTATGCAAGGCAGTCCATGTCATCTACACAGTCAACCTCTACAGCAGTGTC
   CTCATCCTGGCCTTCATCAGTCTGGACCGCTACCTGGCCATCGTCCACGCCACCAACAGTCAGAGGCCAAGGAAGCTGTTGGCTGA
   AAAGGTGGTCTATGTTGGCGTCTGGATCCCTGCCCTCCTGCTGACTATTCCCGACTTCATCTTTGCCAACGTCAGTGAGGCAGATG
   ACAGATATATCTGTGACCGCTTCTACCCCAATGACTTGTGGGTGGTTGTGTTCCAGTTTCAGCACATCATGGTTGGCCTTATCCTG
   CCTGGTATTGTCATCCTGTCCTGCTATTGCATTATCATCTCCAAGCTGTCACATTCCAAGGGCCACCAGAAGCGCAAGGCCCTCAA
   GACCACAGTCATCCTCATCCTGGCTTTCTTCGCCTGTTGGCTGCCTTACTACATTGGGATCAGCATCGACTCCTTCATCCTCCTGG
   AAATCATCAAGCAAGGGTGTGAGTTTGAGAACACTGTGCACAAGTGGATTTCCATCACCGAGGCCCTAGCTTTCTTCCACTGTTGT
   CTGAACCCATCCTCTATGCTTTCCTTGGAGCCAAATTTAAAACCTCTGCCCAGCACGCACTCACCTCTGTGAGCAGAGGGTCCAG
   CCTCAAGATCCTCTCCAAAGGAAAGCGAGGTGGACATTCATCTGTTTCCACTGAGTCTGAGTCTTCAAGTTTTCACTCCAGCTAAC
   ACAGATGTAAAAGACTTTTTTTATACGATAAATAACTTTTTTTAAGTTACACATTTTCAGATATAAAAGCATGACCAATATTG
   TACAGTTTTTATTGCTTGTTGGATTTTTGTCTTGTGTTTCTTTAGTTTTGTGAAGTTTAATTGACTTATTTATATAAATTTTTT
   TGTTTCATATTGATGTGTGTCTAGGCAGGACCTGTGGCCAAGTTCTTAGTTGCTGTATGTCTCGTGGTAGGACTGTAGAAAAGGGA
   ACTGAACATTCCAGAGCGTGTAGTGAATCACGTAAAGCTAGAAATGATCCCCAGCTGTTTATGCATAGATAATCTCTCCATTCCCG
   TGGAACGTTTTTCCTGTTCTTAAGACGTGATTTTGCTGTAGAAGATGGCACTTATAACCAAAGCCCAAAGTGGTATAGAAATGCTG
   GTTTTTCAGTTTTCAGGAGTGGGTTGATTTCAGCACCTACAGTGTACAGTCTTGTATTAAGTTGTTAATAAAAGTACATGTTAAAC
   TTAAAAAAAAAAAAAAAAA
```

TABLE 1-continued

Sequences Table. First column: SEQ ID No. Second column: corresponding mRNA sequence. For the 3 different groups, see explanation in the text.

07 GAGTCGGGGATAAACACTCCGCGGCGGTGGCGGCTGCTGCTCTGCTCCGGGTTCTGTCACTGTGTCGGCGGTGCCCAGCTCACTGG
CCCCCTCCCTCTCTTGTCGAGCGTGGTTGCCAGAGAGGCTCCCTCAGCCCTGCTCCGCGGGGTCCACAGCGGGCTCCACAGCGGGC
TCCATAGCGGGCTCCACAGCGGTCCGGCGGCGGCAGCGAGCCCGTGGGCAGTGGGGGTTGGTCCCGTGGCTCCGGCCCCGGTGCA
GAATGGCGGCGGCGGTTCGGATGAACATCCAGATGCTGCTGGAGGCGGCCGACTATCTGGAGCGGCGGGAGAGAGAAGCTGAACAT
GGTTATGCCTCCATGTTACCATACAATAACAAGGACAGAGATGCCTTAAAACGGAGGAACAAATCCAAAAAGAATAACAGCAGTAG
CAGATCAACTCACAATGAAATGGAGAAGAATAGACGGGCTCATCTTCGCTTGTGCCTGGAGAAGTTGAAGGGGCTGGTGCCACTTG
GACCCGAATCAAGTCGACACACTACGTTGAGTTTATTAACAAAAGCCAAATTGCACATAAAGAAACTTGAAGATTGTGACAGAAAA
GCCGTTCACCAAATCGACCAGCTTCAGCGAGAGCAGCGACACCTGAAGAGGCAGCTGGAGAAGCTGGGCATTGAGAGGATCCGGAT
GGACAGCATCGGCTCCACCGTCTCCTCGGAGCGCTCCGACTCCGACAGGGAAGAAATCGACGTTGACGTGGAGAGCACGGACTATC
TCACAGGTGATCTGGACTGGAGCAGCAGCAGTGTGAGCGACTCTGACGAGCGGGGCAGCATGCAGAGCCTCGGCAGTGATGAGGGC
TATTCCAGCACCAGCATCAAGAGAATAAAGCTGCAGGACAGTCACAAGGCGTGTCTTGGTCTCTAAGAGAGTGGGCACTGCGGCTG
TCTCCTTGAAGGTTCTCCCTGTTGGTTCTGATTAGGTAACGTATTGGACTGCCCACAACTCCCTTGCACGTAAACTTCAGTGTCC
CACCTTGACCAAAATCAGCTTTGTAACTGTTTTCAAGGAGGTGCTTAGGATTGTGGGTTTCTGATTGCATCCACTAGCTTCTCTTT
TTCTCGCCATAAAAATTTGTCTCTGAGAGACTATACATTCCAATCAATTTGAAGCATCCAAGAATTCTTAGACCGAATAAGCAATG
TCCACATCTCAGCAATCCCCCTCTTTGCTCTCCTCGTGTCCTCTCCCAGACCTTTCTTCCAGTTTTCTGGCTTACTGTGTTACTTG
CCTAGGAGGAATGTCCAAGTGTGTCTTGTACTTAGGAAACTGAAGGAAACAAACTTTTGAAATTGAGATCCTGATCTCAGAACTCC
AAAGTAAGCTTTGAAAGCAGCATTTAAGAGCACTTAACCATGGACCTCACCACCAGTGAGGAAGTCAGGAATACCTCTAGAAAACA
CGCCCTTCACACCGCGCATGCTCATTCCCCCGACGCGCCGCGTGTGGATGGGAGCAGTATTTCTCACTTTAAAATGGACACCTTGA
TAGTGTGTCTCTGGGGTTGCACAGCTCATCAAAGTTCCAAATTGTTTGTTCTCACAAACAAAACGGTACAATCTATTTTTGTGCGA
TGTTCTTGGGACCTCGCTGTGTTCTGCTATCTCGAGGCACATTCTCCCCTCCAACTTTGTTAATGCTACTTGTCTCTGGAACATTT
TTTTTTCCTACCTCAGAGATAAATGAGATCTCCATTTCCCACTTAACACAGTGATTATCCTTTTTCCCCCCCCAAAATAGTGACA
TTTGGTCCAATTATAATCTATTTTCCTATTGAACTTTCAGCAATAACTGAGCTGTGGCACTAGCAGAGCTAGTAGCCATTATCAGT
GAAAGAAAAAGTCCACATTTCTACTCTCTGTTGCAGGTGAACAGGAGAGGATGGTACACTGTTACTAGAACTCCTCTCCTTATTGA
TTATTTTTGGACACACCCAGAAACTTCTTTATGGAGGCTTTTGGGTTGATAGTTTAAAAGGCTGATTTTTCTTTTTGGTTATGATT
TCTCCCTTAAGTGGTCTCCGACTTTGTAGCATTTTTATTTAAGCTAAAACAGAGCACATGTATATGTACATAAGACACATTAAATC
TATAAATACTATTTATTCATTTTATATAAACTAATGTAATGGAAAACAAATTCTTATGACTTTGTGGTTTTATAGATGTTCTAGAA
ACTTTGTATGTAGGTATCTACAAAATTAGTTCATTCCCCTGAATATTTTTGCATTCATATTTTTGAGGTCTTGATGTTTTCAGCCT
CTGGCGAATCTTTTTCATTGAATTTGAACCATTTGTAAAATCTGTGATGCTGAAGCAGAGTGTGTCACAAAGTGATGAGAACATTA
CTAAAATCCACGGACGCACTGCGACCTAAGGGCTCAACGGCTGACTCGGCAGCGGGCAGCCACCCCACGCTCCCCTGCGGTCACTC
GCACACCACAGCCTGAAGCTCCCCCAGCGCCTGCACCTCGCACACAGCTAAGGTCAAAGTTCAAACGCACTCCACACGGAAGCTCA
TTCTATACCCGAAGAGCAGTCTCAGAAAGCAAGATTACTTTTGTGTTTTTTAAAAAATGATTCTTTAATGTATTTTCTAAACATT
CTGATTGGAAGTAGTGGATTCCTAAATGATTCCAAAGTCACCTGTAATTCTTCTGTTTTTGTTTTGTTCTGTCTTTTCTTCATTTT
GGCTTTGGGTGGGGGAGGGGCAGGTGACACAAAGGATTTTTTTTTTTTTTAATTTTTGGAATCTTTTTCCAATAACCAGCTA
AAGATTTGCACTGAAATACAACTTGTATGCCTTTTGCATTTTTAAAGCCTGCTTCCTGGATTTAAGCAGAGTGATAGTGTTCAAAG
AGCCAGTTCAGCCTGTAACATATTTGAAAAAGATATGTCTGCACTTTGAGGTCCCTTTTGAATGCCATTCACTAGACCTCTCAAGC
ATTTTGTTTCATTGCTACATCCAAGCGCCTCACAAGTCCACAATGCGGGACAGCATCAAAAGCTCAAGACTTTGGAAAAAGCTTGT
GGGCTTGCACTGGGGAGGGAGGGGAACAAAATTTGTGTACTTCTTTGTTTAATTTAGAAATAAGGCATCCAAGAGATGCCATTAT
TTTCTGTGTTTCAATTGTTGTGCCTTTGAGTTAAACTGCATTTTTGTCTTTTGGTTGAAATCTGAAATGTACTGTCCCAATATAAA
ACAGTAATTATTTGACCTTTGCACTGTTTTGTCTGGTCCTTTTCAGTTTGATTGCATATAAATGTGGAACTTGATAGATCTCTATAT
TTTTAATGCACTTGTGATAAACTGGCAGCAGGGTTAGACATTACTTTCAAAGCTTGAGGTAGACCGAGTCAGCATGCTAGACAGGC
TTCTCTCTCTAACCAAAACTGTAATCTTCAGGACCAGCAAACTCAGCCCAAGGCACTAATCCCCCAACCCCATCCTCCGCGCCC
CGTGCGGCTGATCGGCAGCCCTGATTCGCCAATTTGTCCTCTCTCATTCACTGATCCACCAGCCTGACTGCTAAGAGCTATAGTCT
TTTTAGTTGTTTTGTCTTTTTAAGCAAGATGAAAACCTTTCTATTAGGGATTTTGGGGTTGGGAGGGGATGGGCAGAGATATAAAC
CCCAGCCTTTAAGACTTTGACAATTGTACGTAAATACAGATGTGTATAAATATAGGCACATGCATATTTTTATGTGAAAGTTGATT
TTAAAAAACTAAAAAAATCTAAACTGCACTCTTATTGATACACATACAACACACACACATATTATTATTTAGGTTTTTATACCATACTG
TATTGGCGAGAATACCACTATCATTGTCCTTTACAGTCTATTTCTTCCCCCAAGTCTTGGTCTTTTTTATTTTCTATTTTTTCAT
GAACCACACAGGAGACTTTAACATCCTGGTCTTTTCTGTTTCTTCTTTGTTTCCCCAAGTTTGTCTGTCCCCCTTTGCCTTCCCTG
AGTGTTGAACATCAGGTAGTAAAAGGCTAAACGCAATTTCTTGCATGTCAATCTATTCTTTTTCTATGTTTGACTCTGATGCAGTG
TGTTTAGCGTGTCTAGTAGCTGGCTACTCCTATTTAAAAACTCTTCCTGGTAGAAGACAACCCAAAGACCCTTTTCGATGAGGTGG
TTTCTCATTCTACATCCTCTGATCTCTATAGACTGTAGGATGCTTTGCTTTCAAAGATAACTGGGTTAGAGGGTGGGGTGTCGCAAT
AGGTGATTTATCATGGTTTTTTTCATTATCAATATTACATGGATGATTTTCTCAGATTCTTCTGAAAGAAGAAATTGACAGGCACT
GCTAGATTCAGCTATTGAATGGCTGAAGAGATTGAGTATTTGACCTTCTCTCAAAATCATAAAGTGAGAATTCATAAGGCACCCAA
TGTTAAGATTTATCCAGATTTTTACATTTTGATTTCTTCTCTCTGTGGGGTGGCAAGTTGAGGGAGCATTCTTCATTTTAGCTTTT
ACCTGACAACCAAACTTGCCTTTACCCCATCCCTGAAGATTCTCTTGGAAATATTGCTTGTTACCATCATTTTTGGGGGGCCATC
TTCCTAATGCTACACACAGCCTGACAGGGGAGCAGCAGATGAAAGGGTATGCTATTCTGTTTCCAGATGTTTCTTTATGTAAATAT
GACGCCAATGTAAATCCTGTGTCAAGATCATAGAGAATGGTGCTTTTTACTACAGTTAGCACATGCATTTTTAGAAACTACTACAT
GTTTTAGAGAATCTTTGCTGTGTATATGTAAACTGTATTGTTCAACTGTTAACAAATAATAAATTATTTCATTATTAAAGAAA

08 CAATTGTCATACGACTTGCAGTGAGCGTCAGGAGCACGTCCAGGAACTCCTCAGCAGCGCCTCCTTCAGCTCCACAGCCAGACGCC
CTCAGACAGCAAAGCCTACCCCCGCGCCGCGCCCTGCCCGCCGCTCGGATGCTCGCCCGCGCCCTGCTGCTGTGCGCGGTCCTGGC
GCTCAGCCATACAGCAAATCCTTGCTGTTCCCACCCATGTCAAAACCGAGGTGTATGTATGAGTGTGGGATTTGACCAGTATAAGT
GCGATTGTACCCGGACAGGATTCTATGGAGAAAACTGCTCAACAGATTTTTGACAAGAATAAAATTATTTCTGAAACCCACT
CCAAACACAGTGCACTACATACTTACCCACTTCAAGGGATTTTGGAACGTTGTGAATAACATTCCCTTCCTTCGAAATGCAATTAT
GAGTTATGTCTTGACATCCAGATCACATTTGATTGACAGTCCACCAACTTACAATGCTGACTATGGCTACAAAAGCTGGGAAGCCT
TCTCTAACCTCTCCTATTATACTAGAGCCCTTCCTCCTGTGCCTGATGATTGCCCGACTCCCTTGGGTGTCAAAGGTAAAAGCAG
CTTCCTGATTCAAATGAGATTGTGGAAAAATTGCTTCTAAGAAGAAAGTTCATCCCTGATCCCCAGGGCTCAAACATGATGTTTGC
ATTCTTTGCCCAGCACTTCACGCATCAGTTTTTCAAGACAGATCATAAGCGAGGGCCAGCTTTCACCAACGGGCTGGGCCATGGGG

TABLE 1-continued

Sequences Table. First column: SEQ ID No. Second
column: corresponding mRNA sequence. For the 3 different
groups, see explanation in the text.

```
   TGGACTTAAATCATATTTACGGTGAAACTCTGGCTAGACAGCGTAAACTGCGCCTTTTCAAGGATGGAAAAATGAAATATCAGATA
   ATTGATGGAGAGATGTATCCTCCCACAGTCAAAGATACTCAGGCAGAGATGATCTACCCTCCTCAAGTCCCTGAGCATCTACGGTT
   TGCTGTGGGGCAGGAGGTCTTTGGTCTGGTGCCTGGTCTGATGATGTATGCCACAATCTGGCTGCGGGAACACAACAGAGTATGCG
   ATGTGCTTAAACAGGAGCATCCTGAATGGGGTGATGAGCAGTTGTTCCAGACAAGCAGGCTAATACTGATAGGAGAGACTATTAAG
   ATTGTGATTGAAGATTATGTGCAACACTTGAGTGGCTATCACTTCAAACTGAAATTTGACCCAGAACTACTTTTCAACAAACAATT
   CCAGTACCAAAATCGTATTGCTGCTGAATTTAACACCCTCTATCACTGGCATCCCCTTCTGCCTGACACCTTTCAAATTCATGACC
   AGAAATACAACTATCAACAGTTTATCTACAACAACTCTATATTGCTGGAACATGGAATTACCCAGTTTGTTGAATCATTCACCAGG
   CAAATTGCTGGCAGGGTTGCTGGTGGTAGGAATGTTCCACCCGCAGTACAGAAAGTATCACAGGCTTCCATTGACCAGAGCAGGCA
   GATGAAATACCAGTCTTTTAATGAGTACCGCAAACGCTTTATGCTGAAGCCCTATGAATCATTTGAAGAACTTACAGGAGAAAAGG
   AAATGTCTGCAGAGTTGGAAGCACTCTATGGTGACATCGATGCTGTGGAGCTGTATCCTGCCCTTCTGGTAGAAAAGCCTCGGCCA
   GATGCCATCTTTGGTGAAACCATGGTAGAAGTTGGAGCACCATTCTCCTTGAAAGGACTTATGGGTAATGTTATATGTTCTCCTGC
   CTACTGGAAGCCAAGCACTTTTGGTGGAGAAGTGGGTTTTCAAATCATCAACACTGCCTCAATTCAGTCTCTCATCTGCAATAACG
   TGAAGGGCTGTCCCTTTACTTCATTCAGTGTTCCAGATCCAGAGCTCATTAAAACAGTCACCATCAATGCAAGTTCTTCCCGCTCC
   GGACTAGATGATATCAATCCCACAGTACTACTAAAAGAACGTTCGACTGAACTGTAGAAGTCTAATGATCATATTTATTTATTTAT
   ATGAACCATGTCTATTAATTTAATTATTTAATAATATTTATATTAAACTCCTTATGTTACTTAACATCTTCTGTAACAGAAGTCAG
   TACTCCTGTTGCGGAGAAAGGAGTCATACTTGTGAAGACTTTTATGTCACTACTCTAAAGATTTTGCTGTTGCTGTTAAGTTTGGA
   AAACAGTTTTTATTCTGTTTTATAAACCAGAGAGAAATGAGTTTTGACGTCTTTTTACTTGAATTTCAACTTATATTATAAGAACG
   AAAGTAAAGATGTTTGAATACTTAAACACTATCACAAGATGGCAAAATGCTGAAAGTTTTTACACTGTCGATGTTTCCAATGCATC
   TTCCATGATGCATTAGAAGTAACTAATGTTTGAAATTTTAAAGTACTTTTGGTTATTTTTCTGTCATCAAACAAAAACAGGTATCA
   GTGCATTATTAAATGAATATTTAAATTAGACATTACCAGTAATTTCATGTCTACTTTTTAAAATCAGCAATGAAACAATAATTTGA
   AATTTCTAAATTCATAGGGTAGAATCACCTGTAAAAGCTTGTTTGATTCTTAAAACTTGTACATATACCAAAAAGAA
   GCTGTCTTGGATTTAAATCTGTAAAATCAGATGAAATTTTACTACAATTGCTTGTTAAAATATTTTATAAGTGATGTTCCTTTTTC
   ACCAAGAGTATAAACCTTTTTAGTGTGACTGTTAAAACTTCCTTTTAAATCAAAATGCCAAATTTATTAAGGTGGTGGAGCCACTG
   CAGTGTTATCTCAAAATAAGAATATTTTGTTGAGATATTCCAGAATTTGTTTATATGGCTGGTAACATGTAAAATCTATATCAGCA
   AAAGGGTCTACCTTTAAAATAAGCAATAACAAAGAAGAAACAAATTATTGTTCAAATTTAGGTTTAAACTTTTGAAGCAAACTT
   TTTTTTATCCTTGTGCACTGCAGGCCTGGTACTCAGATTTTGCTATGAGGTTAATGAAGTACCAAGCTGTGCTTGAATAACGATAT
   GTTTTCTCAGATTTTCTGTTGTACAGTTTAATTTAGCAGTCCATATCACATTGCAAAGTAGCAATGACCTCATAAAATACCTCTT
   CAAAATGCTTAAATTCATTTCACACATTAATTTTATCTCAGTCTTGAAGCCAATTCAGTAGGTGCATTGGAATCAAGCCTGGCTAC
   CTGCATGCTGTTCCTTTCTTTTCTTCTTTTAGCCATTTTGCTAAGAGACACAGTCTTCTCATCACTTCGTTTCTCCTATTTTGTT
   TTACTAGTTTTAAGATCAGAGTTCACTTTCTTTGGACTCTGCCTATATTTCTTACCTGAACTTTTGCAAGTTTTCAGGTAAACCT
   CAGCTCAGGACTGCTATTTAGCTCCTCTTAAGAAGATTAAAAGAGAAAAAAAAAGGCCCTTTTAAAAATAGTATACACTTATTTTA
   AGTGAAAAGCAGAGAATTTTATTTATAGCTAATTTTAGCTATCTGTAACCAAGATGGATGCAAAGAGGCTAGTGCCTCAGAGAGAA
   CTGTACGGGGTTTGTGACTGGAAAAAGTTACGTTCCCATTCTAATTAATGCCCTTTCTTATTTAAAAACAAAACCAAATGATATCT
   AAGTAGTTCTCAGCAATAATAATAATGACGATAATACTTCTTTTCCACATCTCATTGTCACTGACATTTAATGGTACTGTATATTA
   CTTAATTTATTGAAGATTATTATTTATGTCTTATTAGGACACTATGGTTATAAACTGTGTTTAAGCCTACAATCATTGATTTTTT
   TTGTTATGTCACAATCAGTATATTTTCTTTGGGGTTACCTCTCTGAATATTATGTAAACAATCCAAAGAAATGATTGTATTAAGAT
   TTGTGAATAAATTTTTAGAAATCTGATTGGCATATTGAGATATTTAAGGTTGAATGTTTGTCCTTAGGATAGGCCTATGTGCTAGC
   CCACAAAGAATATTGTCTCATTAGCCTGAATGTGCCATAAGACTGACCTTTTAAAATGTTTTGAGGGATCTGTGGATGCTTCGTTA
   ATTTGTTCAGCCACAATTTATTGAGAAAATATTCTGTGTCAAGCATCGTGGGTTTTAATATTTTTAAATCAAACGCTGATTACAGA
   TAATAGTATTTATATAAATAATTGAAAAAAATTTTCTTTTGGGAAGAGGGAGAAATGAAATAAATATCATTAAAGATAACTCAGG
   AGAATCTTCTTTACAATTTTACGTTTAGAATGTTTAAGGTTAAGAAAGAAATAGTCAATATGCTTGTATAAAACACTGTTCACTGT
   TTTTTTTAAAAAAAAACTTGATTTGTTATTAACATTGATCTGCTGACAAAACCTGGGAATTTGGGTTGTGTATGCGAATGTTTCA
   GTGCCTCAGACAAATGTGTATTTAACTTATGTAAAAGATAAGTCTGGAAATAAATGTCTGTTTATTTTTGTACTATTTA

09 CTCGCTGCGCCACCGCCTCCCGCCACCCCTGCCCGCCCGACAGCGCCGCCGCCTGCCCGCCATGGGTCGACAGAAGGAGCTGGTG
   TCCCGCTGCGGGGAGATGCTCCACATCCGCTACCGGCTGCTCCGACAGGCGCTGCCGAGTGCCTGGGACCCTCATCTGGTGAT
   GTTTGGCTGTGGCTCCGTGGCCCAGGTTGTGCTCAGCCGGGGCACCCACGGTGGTTTCCTCACCATCAACCTGGCCTTTGGCTTTG
   CTGTCACTCTGGGCATCCTCATCGCTGGCCAGGTCTCTGGGGCCCACCTGAACCCTGCCGTGACCTTTGCCATGTGCTTCCTGGCT
   CGTGAGCCCTGGATCAAGCTGCCCATCTACACCCTGGCACAGACGCTGGGAGCCTTCTTGGGTGCTGGAATAGTTTTTGGGCTGTA
   TTATGATGCAATCTGGCACTTCGCCGACAACCAGCTTTTTCGTTTCGGGCCCCAATGGCACAGCCGGCATCTTTGCTACCTACCCCT
   CTGGACACTTGGATATGATCAATGGCTTCTTTGACCAGTTCATAGGCACAGCCTCCCTTATCGTGTGTGGCTGGCCATTGTTGAC
   CCCTACAACAACCCCGTCCCCGAGGCCTGGAGGCCTTCACCGTGGGCTGGTGGTCCTGGTCATTGGCACCTCCATGGGCTTCAA
   CTCCGGCTATGCCGTCAACCCTGCCCGGGACTTTGGCCCCCGCCTTTTTACAGCCCTTGCGGGCTGGGGCTCTGCAGTCTTCACGA
   CCGGCCAGCATTGGTGGTGGGTGCCCATCGTGTCCCCACTCCTGGGCTCCATTGGGGTGCTTCGTGTACCAGCTGATGATCGGC
   TGCCACCTGGAGCAGCCCCCACCCTCCAACGAGGAAGAGAATGTGAAGCTGGCCCATGTGAAGCACAAGGAGCAGATCTGAGTGGG
   CAGGGGCCATCTCCCCACTCCGCTGCCCTGGCCTTGAGCATCCACTGACTGTCAAGGGCCACTCCCAAGAAGCCCCCTTCACGAT
   CCACCCTTTCAGGCTAAGGAGCTCCCTATCTACCCTCACCCCACGAGACAGCCCCTTCAGGATTTCCACTGGACCTTGCCCAAATA
   GCACCTTAGGCCACTGCCCCTAAGCTGGGGTGGAACCGGAATTTGGGTCAATACATCCTTTTGTCTCCCAAGGGAAGAGAATGGGC
   AGCAGGTATGTGTGTGTGCATGTGTGCATGTGTGTGCATGTGTGTGCAGGGGTGTGTGTGTGGGGGGGGGTTCCCAGATAT
   TCAGGGCAAGGGACCAGTCGGAAGGGATTCTGGCTATTGGGGGAGCCCAGAGACAGGGGAAGGCAGCCTGTCCATCTGTCCATAAG
   GAGAGGAAAGTTCCAGGGTGTGTATGTTTCAGGGGCTTCACATGGAGGAGCTGCAGATAGATATGTTTCTGTGTATGTGTATGT
   CTGCCTTTTTTCTAAGTGGGGGCTTCTACAGGCTTTTGGGAAGTAGGGTGGATGTGGGTAGGGCTGGGAGGAGGGGGCCACAGCT
   TAGGTTTGGAGCTCTGGATGTACATACATAAGTAGGAGCAGTGGGACGTGTTTCTGTCATAATGCAGGCATGAAGGGTGGAGTGAA
   GTCAGGTCATAAGTTTCATGTTTGCTTTTGTTTTGTTTTGTTTTTAATGTATGTAGCAGATGTTACAGTCTTAGGGATCCGGGATG
   GGAGACCCCACTTTAGAAAGGGTCGTCACTCCTTTAATCCTCTACTAACAATGTACTCTTTTACTTTTATATTAAAAAAATAAA
   ATAAATATGTGCCTAAAAAAAAAAAAAAA

10 GCGGTGGCGCTGCGGAGACCCGGTCCAGACGCCTGGCGGCCGCCGGCACACAAGGCGCTTTCTAGCTCCCTCCCCCGAGCGCACAG
   CCCGCCTCCTTCCGCGGCGCCTGCAGTGGCAGGCTTGCTCTGCCCTACCGTGACGCGCTCCGGAGACGCTCTGCGGGTCCTGGACA
   CCGGGTCCGCGGCGTGGGGACGACAGACGGAGGCGAACGCCATCGGTAGCCGGTCCGCGAGCCATCGTTCGGGGCGCAGTCCTCTC
   CCCGGCTGGCCTCCTTTCTCCGGGGCATTCGCCACCGCTTCCCTGGGCTGGAGACGACCGGTTCGTCGCCTCCGTGACCG
   TCGCTAGAACTCAGTTGTGCGTTGCGGCCAGTCGCCACTGCTGAGTGGAAGCAAAATGTCAGTCAGTGCATGAGAACCGCAAGT
   CCAGGGCCAGCAGCGGCTCCATTAACATCTATCTGTTTCACAAGTCCTCCTACGCTGACAGCGTCCTCACTCACCTGAATCTTTTA
   CGCCAGCAGCGCTCTCTTCACTGACGTCCTTCTCCATGCCGGAAATAGGACCTTCCCTTGCCACCGGGCAGTGCTGGCTGCATGCAG
   TCGCTACTTTGAGGCCATGTTCAGTGGTGGCCTGAAAGAGAGCCAGGACAGTGAGGTCAACTTTGACAATTCCATCCACCCAGAAG
   TCTTGGAGCTGCTGCTTGACTATGCGTACTCCTCCCGGGTCATCATCAATGAAGAAAATGCAGAATCGCTCCTGGAAGCTGGTGAC
```

TABLE 1-continued

Sequences Table. First column: SEQ ID No. Second column: corresponding mRNA sequence. For the 3 different groups, see explanation in the text.

ATGCTGGAGTTTCAAGACATCCGGGATGCATGTGCAGAGTTCCTGGAAAAGAACCTGCATCCCACCAACTGCCTGGGCATGCTGCT
GCTGTCTGATGCACACCAGTGCACCAAGCTGTACGAACTATCTTGGAGAATGTGTCTCAGCAACTTCCAAACCATCAGGAAGAATG
AAGATTTCCTCCAGCTGCCCCAGGACATGGTAGTGCAACTCTTGTCCAGTGAAGAGCTGGAGACAGAGGATGAAAGGCTTGTGTAC
GAGTCTGCAATTAACTGGATCAGCTATGACCTGAAGAAGCGCTATTGCTACCTCCCAGAACTGTTGCAGACAGTAAGGCTGGCACT
TCTGCCAGCCATCTATCTCATGGAGAATGTGGCCATGGAGGAACTCATCACCAAGCAGAGAAAGAGTAAGGAAATTGTGGAAGAGG
CCATCAGGTGCAAACTGAAAATCCTGCAGAATGACGGTGTGGTAACCAGCCTCTGTGCCCGACCTCGGAAAACTGGCCATGCCCTC
TTCCTTCTGGGAGGACAGACTTTCATGTGTGACAAGTTGTATCTGGTAGACCAGAAGGCCAAAGAAATCATTCCCAAGGCTGACAT
TCCCAGCCCAAGAAAAGAGTTTAGTGCATGTGCGATTGGCTGCAAAGTGTACATTACTGGGGGGCGGGGGTCTGAAAATGGGGTCT
CGAAAGATGTCTGGGTTTATGATACCCTGCACGAGGAGTGGTCCAAGGCTGCCCCCATGCTGGTGGCCAGGTTTGGCCATGGCTCT
GCTGAACTGAAGCACTGCCTGTATGTGGTTGGGGGGCACACGGCCGCAACTGGCTGCCTCCCGGCCTCCCCCTCAGTCTCTCTAAA
GCAGGTAGAACATTATGACCCCACAATCAACAAATGGACCATGGTGGCCCCACTCCGAGAAGGCGTTAGCAACGCCGCAGTAGTGA
GTGCCAAACTTAAGTTATTTGCTTTCGGAGGTACCAGTGTCAGTCATGACAAGCTCCCCAAAGTTCAGTGTTACGATCAGTGTGAA
AACAGGTGGACTGTACCGGCCACCTGTCCCCAGCCCTGGCGTTACACAGCAGCAGCTGTGCTGGGGAACCAGATTTTTATTATGGG
GGGTGATACAGAATTCTCTGCCTGCTCTGCTTATAAATTCAACAGTGAGACTTACCAGTGGACCAAAGTGGGAGATGTGACAGCGA
AGCGCATGAGCTGCCATGCTGTGGCCTCTGGAAACAAACTCTACGTGGTTGGAGGATACTTTGGCATTCAGCGATGCAAGACTTTG
GACTGCTACGATCCAACATTAGACGTGTGGAACAGCATCACCACTGTCCCGTACTCGCTGATTCCTACTGCATTTGTCAGCACCTG
GAAACATCTGCCTTCTTAAATGCAGTACATTCTAAAGAGATGAGATGAGCTCACTCCATCACTCGATGAGATAATATGAGATTT
CTACTTCGGAGAGGCCAAGTCTAATGAAGAGAAAAAAAGGAAAAGAAGTTGCAAGACTCGAATAAAATCTGCTGCACCTTGTAAAT
GCTCTAACTGGACATGAAGGAAAGGGGCGAGGGAGGGGGTGGGATTTTTGGTGCAAGTAGCACATGGTTTAAATATGAATGAACA
AACCTGTGATCTAGTCCTTGTCTTGTAATTGTGGATTAATGTCAATGTTAATCAGCCCCTCAAAGGGAGAGAAAAGCTGGACCTTT
TCCCTTGCTGTACCATATTCAGCATTTGATTTCCATGGGCCCCACCATTTATGTGTAGAATTTGAAATGGTTGTCACCTCTCTCTG
AGGACAGAGCTTGAAGCCTCCACACCAGCTGCTGCTGGAGATTCAAAGCCCAACTGTGGGTCCGAGAGGGAAGCTGGCTGGGCTGG
CTGAAGAATGAAGACCACTGGACTCTCCGTTAATCTCTAAGGGGTCTGCTCCCCAGGAACGTTTCTGAACAATGGGGACTTTGTTG
GTAGCCATTTGGTAGATGTTCTTTTCTATTTATAAGTGACTTTAAACTTTCCCTTGGCTGTTAAGAAGTTTGTTATAGATTTAGCT
ATTTATTGTTCATGCCTGCATGCTGAAACAATGCCTACAGCTGTCTTCACATGTATGGACGTGTGTGAATGGTTGTACGTTTTGC
ACATTTTGTGGCTGTTGAGATGTGCTTTGCTGCACAAACATGAAAATTTTTGAGTTACAATTTGGAGCATAACTGGAGGGTGGGCT
GGGGAGGGGTGGATTTTTAAAATGTCAAGACAGGGAAGGATGACAAAATGGAAATTTAAATGACATCCTAGAGGTAGAGAAACCGT
GGAGATCGCTTTTCTCAGACTCACCAACTTTTAATGGGATTTCATGGGGTTTGGTTGTGCTGATAGGGTAAGGGGAGGCTGCTTTC
TGCCCTTCTCCCCACTCCCATCTGATTTACTTAATTCAGTCTCAGCTGCTGAAATTTGGAAAGGACCAAATTGCTTTACAGTTTTT
TTCTTTGTGTAGTATCTTTGAAATCCTGGAAAATTCTATGGAATAGTTCTGTATATAGGGCACAAGTAAAGGCATTGTCCAAAGTTT
ATTTATTTATTTATTACCCTAAGAATGCTTTGCCATAACCACATTTAATGGGAAAAACGGCATGTATCACAGATGTAAATTAACTC
ACCAGATTTACTGGGCCTGAACTCATTCTCTTCTTGCTATATGATTAGCAAGTTCTAGAAGGTCTCCAAGACAATAATTACATTG
GCACAATGTATACTTCAGTGCTCACCCGTAGCAAATCTCTTTTTAAAAAACTCTTTGGTGCACAAGTAACACATTTGGCCACAAAA
CACCAAAGAATTGTAGGCATGGCCCCTATTGAGAAGTTTTCCGGTAGAGTTGGAAACAGTTGTGAATACATTCTTTGCTAGTTG
GAGTGCTTGTTTACTAAGCATGTGCCGTCGTAGGTATTAGTGCTAGTCTCAAATAGGTGCTTCCCCTGAGGTGCAGGGGAAGACCA
AAGTTTGCAACTCGAACTGCTTTCGTCCATGTTTCTCACATTGCTGTATTTTAGAAAATAGGGGTTAAGACTGATAACAACCTTTT
ACATTGTGACTGTGTTTGCATTGTCTAATGACAGATAAATCCTTAACATTTCTCTCCACCTTAGTACTTTAGACTAATTGTGTTTG
TCCGTCCATGCCATGAATGAGTGGGCTGTAGTTGGGCCTAAATAAATGAGCTGTTGGAAGAAAAAGAATCACAGTACTTTCCAGCAG
TCAGTCCCTGGTTCCTAGATGTGTTCTAAGCAATGCAAATGTCTAATTGTCCCCAGTGGGCATAGTCAGTGTCGTTTATATTGTA
GCAGTTACAGCTCTGTAGTTTATGATGCAAATCTGCCAAGAGAGATGTATGTGTCACTGCATGGCTTCTGAAAGCAGGATGAATTT
TCTGCAGCTGTTTCAAAGTTGGGGTCTGTTCTTGAATCCTCTATTAATTACTGTGTGTGAGCCAGAGGGAGCTGTGGTAAGGGTTG
GGCCCCCAGCCTGTAGGGAACTTTCTGGACTCCCACTCTTTGAATCGATATAGGCATTTGGTCTCACTACTTGACCATTCTCACCC
TGTGAAACGTCCCACACTTTGAAGCAAATACAATTCACAGCACAGTACACACAAAAACCTTGGCATAAGACAGAGAAGGTTCTTCT
TATTTTGTGGGCTGGTTGCTGTAGAAACATATAACAAAGGGCAGCCCTCCACTTCTGGTATAATTGTGTAGCCCCTTTTCTTTGGG
CTTGACACCTGTCTTGAATAAGAGTGATTAGAGCTGCATAATGTCCCTCTCTTGGCTATTGACCATGTGGTTCACGTACAAAACTC
TGTATAAGTTGAAGGAAAATGTTCATGTTCATATGTACTTGTTTGCTATGACTACATTTTGAGGTTTTGTAAAACTGTTATTTTTT
TTTTTTTCACAATGTGAAACTGAAGGTCAATAAATTATTAGAGATTTTCTCTTCAAAAAAAAAAAAAAAAAAAAAAAAAAAAAAAA
AAAAAAAAAA

11 GAGGACTGCAGTGTAGGACTTTCCTGCAGAATACCATTTGATCCTATTAAGAATTGTCCAAATGTTGGAGCATTTGATTGAAAAAT
CCTTCTTAGCCATTTTAAAGATAGCTTTCCAATGATTAGACGAATTGATTCTTTCTGTGACTCATCAGTTCATTTCCTGTAAAATT
CATGTCTTGCTGTTGATTTGTGAATAAGAACCAGAGCTTGTAGAAACCACTTTAATCATATCCAGGAGTTTGCAAGAAACAGGTGC
TTAACACTAATTCACCTCCTGAACAAGAAAAATGGGCTGTGACCGAACTGTGGGCTCATCGCTGGGGCTGTCATTGGTGCTGTCC
TGGCTGTGTTTGGAGGTATTCTAATGCCAGTTGGAGACCTGCTTATCCAGAAGCAATTAAAAAGCAAGTTGTCCTCGAAGAAGGT
ACAATTGCTTTTAAAAATTGGGTTAAAACAGGCACAGAAGTTTACAGACAGTTTTGGATCTTTGATGTGCAAAATCCACAGGAAGT
GATGATGAACAGCAGCAACATTCAAGTTAAGCAAAGAGGTCCTTATACGTACAGAGTTCGTTTTCTAGCCAAGGAAAATGTAACCC
AGGACGCTGAGGACAACACAGTCTCTTTCCTGCAGCCCAATGGTGCCATCTTCGAACCTTCACTATCAGTTGGAACAGAGGCTGAC
AACTTCACAGTTCTCAATCTGGCTGTGGCAGCTGCATCCCATATCTATCAAAATCAATTTGTTCAAATGATCCTCAATTCACTTAT
TAACAAGTCAAAATCTTCTATGTTCCAAGTCAGAACTTTGAGAGAACTGTTATGGGCTATAGGGATCCATTTTTGAGTTTGGTTC
CGTACCCTGTTACTACCACAGTTGGTCTGTTTTATCCTTACAACAATACTGCAGATGGAGTTTATAAAGTTTTCAATGGAAAAGAT
AACATAAGTAAAGTTGCCATAATCGACACATATAAAGGTAAAAGGAATCTGTCCTATTGGGAAAGTCACTGCGACATGATTAATGG
TACAGATGCAGCCTCATTTCCACCTTTTGTTGAGAAAAGCCAGGTATTGCAGTTCTTTTCTTCTGATATTTGCAGGTCAATCTATG
CTGTATTTGAATCCGACGTTAATCTGAAAGGAATCCCTGTGTATGATTGTTCTTCATCCAAGGCCTTTGCCTCTCCAGTTGAA
AACCCAGACAACTATTGTTTCTGCACAGAAAAAATTATCTCAAAAAATTGTACATCATATGGTGTGCTAGACATCAGCAAATGCAA
AGAAGGGAGACCTGTGTACATTTCACTTCCTCATTTTCTGTATGCAAGTCCTGATGTTTCAGAACCTATTGATGGATTAAACCCAA
ATGAAGAAGAACATAGGACATACTTGGATATTGAACCTATAACTGGATTCACTTTACAATTTGCAAAACGGCTGCAGGTCAACCTA
TTGGTCAAGCCATCAGAAAAAATTCAAGTATTAAAGAATCTGAAGAGGAACTATATTGTGCCTATTCTTTGGCTTAATGAGACTGG
GACCATTGGTATGAGAAGGCAAACATGTTCAGAAGTCAAGTAACTCAAGAACCTCCTTGGCCTGATGATAGAAATGATCTTAC
TCAGTGTTGGTGTGGTGATGTTTGTTGCTTTTATGATTTTCATATTGTGCATGCAGATCGAAAACAATAAAATAAACCTGGCTCAAG
CACAAACCAATTTGTGTTGTTCTGATTCAATAATTGGTTTCTGGGTGGCCAATTCAGAAGAAGAGTGTACATGCTCAACAATCCT
AGGCCCTGCATTCCTGTCATCCTCATCCGGGGGAAACACCATCATCCCAGTAGCTGCCCTATTCAACTGCAACAGTCTCCAGGACC
ATCAGTATACTGCATTTCATGTGCACCAAATATTTTGAAAGACATTTATAAATAATTGGCTTATGACTCATATTCTCTATGAATA
CCTTCATACAGCAGGTATAACTCTTTTCTTTATGGGCTTAAATATTTTGTCACTGATCCTGCAAATGGACATCATTTTAGCACACT
AGCGGTTTATATTTTAAGGACCTTCATTCTCTGTTCTGCACCTCTTCTGGAAATTGAGTAAATTTTGCTTTTTTTTTTTTTTACTCAG

TABLE 1-continued

Sequences Table. First column: SEQ ID No. Second column: corresponding mRNA sequence. For the 3 different groups, see explanation in the text.

|    |    |
|----|----|
|    | TTGCAACTTACGCTTGGCATCTTCAGAATGCTTTTCTAGCATTAAGAGATGTAAATGATAAAGGAATTATTGTATGAAATATTACA<br>AAGCGTAGACTATGCATTGTTATTCATTATAATATTTTTTGCTGTCATAATCGCCTCATAAAGACAGGTTTCAACCATTAAAATAT<br>GTTCTTCCTTAAAAAA |
| 12 | AGAAACAGGAGCAGATGTACAGGGTTTGCCTGACTCACACTCAAGGTTGCATAAGCAAGATTTCAAAATTAATCCTATTCTGGAGA<br>CCTCAACCCAATGTACAATGTTCCTGACTGGAAAAGAAGAACTATATTTTTCTGATTTTTTTTTCAAATCTTTACCATTAGTTGC<br>CCTGTATCTCCGCCTTCACTTTCTGCAGGAAACTTTATTTCCTACTTCTGCATGCCAAGTTTCTACCTCTAGATCGTTTGGTTCA<br>GTTGCTGAGAAGCCTGACATACCAGGACTGCCTGAGACAAGCCACAAGCTGAACAGAGAAAGTGGATTGAACAAGGACGCATTTCC<br>CCAGTACATCCACAACATGCTGTCCACATCTCGTTCTCGGTTTATCAGAAATACCAACGAGAGCGGTGAAGAAGTCACCACCTTTT<br>TTGATTATGATTACGGTGCTCCCTGTCATAAATTTGACGTGAAGCAAATTGGGGCCCAACTCCTGCCTCCGCTCTACTCGCTGGTG<br>TTCATCTTTGGTTTTGTGGGCAACATGCTGGTCGTCCTCATCTTAATAAACTGCAAAAAGCTGAAGTGCTTGACTGACATTTACCT<br>GCTCAACCTGGCCATCTCTGATCTGCTTTTTCTTATTACTCTCCCATTGTGGGCTCACTCTGCTGCAAATGAGTGGGTCTTTGGGA<br>ATGCAATGTGCAAATTATTCACAGGGCTGTATCACATCGGTTATTTTGGCGGAATCTTCTTCATCATCCTCCTGACAATCGATAGA<br>TACCTGGCTATTGTCCATGCTGTGTTTGCTTTAAAAGCCAGGACGGTCACCTTTGGGGTGGTGACAAGTGTGATCACCTGGTTGGT<br>GGCTGTGTTTGCTTCTGTCCCAGGAATCATCTTTACTAAATGCCAGAAAGAAGATTCTGTTTATGTCTGTGGCCCTTATTTTCCAC<br>GAGGATGGAATAATTTCCACACAATAATGAGGAACATTTTGGGGCTGGTCCTGCCGCTGCTCATCATGGTCATCTGCTACTCGGGA<br>ATCCTGAAAACCCTGCTTCGGTGTCGAAACGAGAAGAAGAGCCATAGGGCAGTGAGAGTCATCTTCACCATCATGATTGTTTACTT<br>TCTCTTCTGGACTCCCTATAATATTGTCATTCTCCTGAACACCTTCCAGGAATTCTTCGGCCTGAGTAACTGTGAAAGCACCAGTC<br>AACTGGACCAAGCCACGCAGGTGACAGAGACTCTTGGGATGACTCACTGCTGCATCAATCCCATCATCTATGCCTTCGTTGGGGAG<br>AAGTTCAGAAGCCTTTTTCACATAGCTCTTGGCTGTAGGATTGCCCCACTCCAAAAACCAGTGTGTGGAGGTCCAGGAGTGAGACC<br>AGGAAAGAATGTGAAAGTGACTACACAAGGACTCCTCGATGGTCGTGAAAAGGAAGTCAATTGGCAGAGCCCCTGAAGCCAGTC<br>TTCAGGACAAAGAAGGAGCCTAGAGACAGAAATGACAGATCTCTGCTTTGGAAATCACACGTCTGGCTTCACAGATGTGTGATTCA<br>CAGTGTGAATCTTGGTGTCTACGTTACCAGGCAGGAAGGCTGAGAGGAGAGAGACTCCAGCTGGGTTGGAAAACAGTATTTTCCAA<br>ACTACCTTCCAGTTCCTCATTTTTGAATACAGGCATAGAGTTCAGACTTTTTTAAATAGTAAAAATAAAATTAAAGCTGAAAACT<br>GCAACTTGTAAATGTGGTAAAGAGTTAGTTTGAGTTACTATCATGTCAAACGTGAAAATGCTGTATTAGTCACAGAGATAATTCTA<br>GCTTTGAGCTTAAGAATTTTGAGCAGGTGGTATGTTTGGGAGACTGCTGAGTCAACCCAATAGTTGTTGATTGGCAGGAGTTGGAA<br>GTGTGTGATCTGTGGGCACATTAGCCTATGTGCATGCAGCATCTAAGTAATGATGTCGTTTGAATCACAGTATACGCTCCATCGCT<br>GTCATCTCAGCTGGATCTCCATTCTCTCAGGCTTGCTGCCAAAAGCCTTTTGTGTTTTGTTTTGTATCATTATGAAGTCATGCGTT<br>TAATCACATTCGAGTGTTTCAGTGCTTCGCAGATGTCCTTGATGCTCATATTGTTCCCTATTTTGCCAGTGGGAACTCCTAAATCA<br>AGTTGGCTTCTAATCAAAGCTTTTAAACCCTATTGGTAAAGAATGGAAGGTGGAGAAGCTCCCTGAAGTAAGCAAAGACTTTCCTC<br>TTAGTCGAGCCAAGTTAAGAATGTTCTTATGTTGCCCAGTGTGTTTCTGATCTGATGCAAGCAAGAAACACTGGGCTTCTAGAACC<br>AGGCAACTTGGGAACTAGACTCCCAAGCTGGACTATGGCTCTACTTTCAGGCCACATGGCTAAAGAAGGTTTCAGAAAGAAGTGGG<br>GACAGAGCAGAACTTTCACCTTCATATATTTGTATGATCCTAATGAATGCATAAAATGTTAAGTTGATGGTGATGAAATGTAAATA<br>CTGTTTTTAACAACTATGATTTGGAAAATAAATCAATGCTATAACTATGTTGATAAAAGATTTAAAAA |
| 13 | CGCAGCTGGAGCCTGCGGCTGAGGCTCGGGCGCGCTCAGGCCCGGATCCTGGCGGCCTGGGCGGCCGCACCATGGACTCGGGAACC<br>GAGGAGTACGAGCTCAACGGCGGCCTGCCTCCGGGCACACCCGGCTCCCGGACGCCTCGCCGGCCCGCTGGGGCTGGAGGCACGG<br>GCCCATCAACGTGAACCATTACGCCAGCAAGAAGAGCGCAGCCGAGAGCATGCTGGACATCGCGCTGCTGATGGCCAACGCGTCCC<br>AGCTGAAGGCCGTCGTGGAACAGGGCCCCAGCTTCGCCTTCTATGTGCCCCTGGTGGTCCTCATCTCCATCTCCCTTGTGCTGCAG<br>ATCGGCGTGGGGGTGCTGCTCATCTTCCTTGTCAAGTACGACCTTAACAACCCGGACAAGCACGCCAAGCTGGACTTCCTCAACAA<br>CCTGGCCACGGGCCTGGTGTTCATCATCGTGGTAGTCAACATCTTCATCACGGCCTTCGGGGTCCAGAAGCCCTTGATGGACATGG<br>CACCCCAGCAGTAGGACACCCAGGACCCTGGATGCTGCCTGCCCTGCAACTCAGCTGCCCGACCCAGGAGTCGCCATACCTGTGA<br>GGTGTCCACCTCCCTGCACATGGCACTACCCAGACTGCCAGAGCCCAGGCTGGCCTCATCTGCACCATCTCCCCGGACCAGCCCTT<br>GCTCTGACTGCGGCCAAGCACCACGCAGGAGGCCACTCTTGTCTCTCAGCAGCTGTTCCCAGGAGGCAGCTCCCTCCTGGCACATG<br>GGGGCTGGCCACAATAGCCCAGAGGGTCAGAACTGGACAGCTGCAGAGACCTGTGCCCAGAGAAGGGTCTCGACCCACTCAAGGAC<br>ACACAGCAGGTCCGTGGATGGCTGGATGAGTGACCAGGGCCAGCCTCTGTCTCAGGACATTCCAGAAGGACAAGGAGATGTCTCT<br>CCCTCTCCCAAAGCACCAGCGTCCCTGCCTCCCGTGGGCCCTGTCCGGGTTGCCCTGGTGACCCCAGCCTCTGTCCACTTCCTAAC<br>CCAGGGGACCCTGCACAGCCAGAACTGCCTTTGGCCCTACGGATGGCCACTGGCTCTGGTCTAAAGTGCCTGGGCTTGGTGGCCATC<br>AAGAGGGAGCCAGTCAGGCCTGTGAGGGCCGTAGACCTTGTATATACCCTGCACCAGCAGTGACCGGGCAGAGCCCAACCCCCTCC<br>ACGGGGGTCCCAGCACCCACTTTTCTAATCATGAATGAACAATAAAGCCACGCTCTTTGTCAGGCTCAAAAAAAAAAAAAAAAAA<br>AAAAAAAAAAAAAAAAAAA |
| 14 | AGACAGGGGTAGTGCGAGGCCGGGCACAGCCTTCCTGTGTGGTTTTACCGCCCAGAGAGCGTCATGGACCTGGGGAAACCAATGAA<br>AAGCGTGCTGGTGGTGGCTCTCCTTGTCATTTTCCAGGTATGCCTGGTCAAGATGAGGTCACGGACGATTACATCGGAGACAACA<br>CCACAGTGGACTACACTTTGTTCGAGTCTTTGTGCTCCAAGAAGGACGTGCGGAACTTTAAAGCCTGGTTCCTCCCTATCATGTAC<br>TCCATCATTTGTTTCGTGGGCCTACTGGGCAATGGGCTGGTCGTGTTGACCTATATCTATTTCAAGAGGCTCAAGACCATGACCGA<br>TACCTACCTGCTCAACCTGGCGGTGGCAGACATCCTCTTCCTCCTGACCCTTCCCTTCTGGGCCTACAGCGCGGCCAAGTCCTGGG<br>TCTTCGGTGTCCACTTTTGCAAGCTCATCTTTGCCATCTACAAGATGAGCTTCTTCAGTGGCATGCTCCTACTTCTTTGCATCAGC<br>ATTGACCGCTACGTGGCCATCGTCCAGGCTGTCTCAGCTCACCGCCACCGTGCCCGCGTCCTTCTCATCAGCAAGCTGTCCTGTGT<br>GGGCATCTGGATACTAGCCACAGTGCTCTCCATCCCAGAGCTCCTGTACAGTGACCTCCAGAGGAGCAGCAGTGAGCAAGCGATGC<br>GATGCTCTCTCATCACAGAGCATGTGGAGGCCTTTATCACCATCCAGGTGGCCCAGATGGTGATCGGCTTTCTGGTCCCCCTGCTG<br>GCCATGAGCTTCTGTTACCTTGTCATCATCCGCACCCTGCTCCAGGCACGCAACTTTGAGCGCAACAAGGCCATCAAGGTGATCAT<br>CGCTGTGGTCGTGGTCTTCATAGTCTTCCAGCTGCCCTACAATGGGGTGGTCCTGGCCCAGACGGTGGCCAACTTCAACATCACCA<br>GTAGCACCTGTGAGCTCAGTAAGCAACTCAACATCGCCTACGACGTCACCTACAGCCTGGCCTGCCGTCCGCTGCTGCGTCAACCCT<br>TTCTTGTACGCCTTCATCGGCGTCAAGTTCCGCAACGATCTCTTCAAGCTCTTCAAGGACCTGGGCTGCCTCAGCCAGGAGCAGCT<br>CCGGCAGTGGTCTTCCTGTCGGCACATCCGGCGCTCCTCCATGAGTGTGGAGGCCGAGACCACCACCACCTTCTCCCCATAGGCGA<br>CTCTTCTGCCTGGACTAGAGGGACCTCTCCCAGGGTCCCTGGGGTGGGGATAGGGACAGATGCAATGCTCAGGACATCCCCCGG<br>CCAAAAGCTGCTCAGGGAAAAGCAGCTCTCCCCTCAGAGTGCAAGCCCCTGCTCCAGAAGATAGCTTCACCCCAATCCCAGCTACC<br>TCAACCAATGCCAAAAAAAGACAGGGCTGATAAGCTAACACCAGACAGACAACACTGGGAAACAGAGGCTATTGTCCCCTAAACCA<br>AAAACTGAAAGTGAAAGTCCAGAAACTGTTCCCACCTGCTGGAGTGAAGGGCAAGGAGGGTGAGTGCAAGGGGCGTGGGAGTGG<br>CCTGAAGAGTCCTCTGAATGAACCTTCTGGCCTCCCACAGACTCAAATGCTCAGACCAGCTCTTCCGAAAACCAGGCCTTCTCTCC<br>AAGACCAGAGATAGTGGGGAGACTTCTTGGCTTGGTGAGGAAAAGCGGACATCAGCTGGTCAAACAAACTCTCTGAACCCCTCCCT<br>CCATCGTTTTCTTCACTGTCCTCCAAGCCAGCGGGAATGGCAGCTGCCACGCCGCCCTAAAAGCACACTCATCCCCTCACTTGCCG<br>CGTCGCCCTCCCAGGCTCTCAACAGGGGAGAGTGTGGTGTTTCCTGCAGGCCAGGCCAGCTGCCTCCGCGTGATCAAAGCCACACT<br>CTGGGCTCCAGAGTGGGGATGACATGCACTCAGCTCTTGGCTCCACTGGGATGGGAGGAGGACAAGGGAAATGTCAGGGGCGGG<br>GAGGGTGACAGTGGCCGCCCAAGGCCCACGAGCTTGTTCTTTGTTCTTTGTCACAGGGACTGAAAACCTCTCCTCATGTTCTGCTT |

TABLE 1-continued

Sequences Table. First column: SEQ ID No. Second column: corresponding mRNA sequence. For the 3 different groups, see explanation in the text.

TCGATTCGTTAAGAGAGCAACATTTTACCCACACACAGATAAAGTTTTCCCTTGAGGAAACAACAGCTTTAAAAGAAAAAGAAAAA
AAAAGTCTTTGGTAAATGGCAAAAAAAAAAAAAAAAAA

Group 2

15 GGCGCGGAGCTCGGGCGGCCGTGGAGGAACTCAGCCTCGGCCGCAGGAGGCGCGGGAGCGGAGCCGCCGGGAGTCGCGCAACAGG
TTTCCTTCTCCATCGCTGCGCCCACAGGGGACGCGCGCCCTGCCGGGAGAGGGGCTTCTCGGTTCGCACTCTCGCTCCCAGTCCAG
GCAAAATGAAAGACCGGCTAGCAGAACTTCTGGACTTGTCCAAGCAATATGACCAGCAGTTCCCAGACGGGGACGATGAGTTTGAC
TCGCCCCACGAGGACATCGTGTTCGAGACGGACCACATCTCTGGAGTCCCTGTACCGAGACATCCGGGACATTCAGGATGAAAACCA
GCTGCTGGTGGCCGACGTGAAGCGGCTGGGAAAGCAGAACGCCCGCTTCCTCACGTCCATGCGGCGCCTCAGCAGCATCAAGCGCG
ACACCAACTCCATCGCCAAGGCCATCAAGGCCCGGGCGAGGTCATCCACTGCAAGCTGCGCGCCATGAAGGAGCTGAGCGAGGCG
GCTGAGGCCCAGCACGGCCCGCACTCGGCAGTGGCGCGCATTTCGCGGGCGCAGTACAACGCGCTCACCCTCACCTTCCAGCGCGC
CATGCACGACTACAACCAGGCCGAGATGAAGCAGCGCGACAACTGCAAGATCCGCATCCAGCCGCAGCTGGAGATCATGGGCAAGG
AAGTCTCGGGCGACCAGATCGAGGACATGTTCGAGCAGGGTAAGTGGGACGTGTTTTTCCGAGAACTTGCTGGCCGACGTGAAGGGC
GCGCGGGCCGCCCTCAACGAGATCGAGAGCCGCCACCGCGAACTGCTGCGCCTGGAGAGCCGCATCCGCGACGTACACGAGCTCTT
CTTGCAGATGGCGGTGCTGGTGGAGAAGCAGGCCGACACCCTGAACGTCATCGAGCTCAACGTACAAAAGACGGTCGACTACACCG
GCCAGGCCAAGGCGCAGGTGCGGAAGGCCGTGCAGTACGAGGAGAAGAACCCCTGCCGGACCCTCTGCTGCTTCTGCTGTCCCTGC
CTCAAGTAGCAGGCCGGCCCGGGCCGCCACCGCCCATCCCAGACCATGGAGCGCGCTGGGAAGGACGCACCAAAGCGGGAGCTCT
GCCCTGCAGGGAGTTGCCCCAACCCTTTCCGGAACTCAGTCTTTAGAAAAGAAACGCCAGGTTCAAGAATTGCAAACCAGCCTGTG
CTTGGAAAGATGGTTAGTTGATACCGTCCGATGATTCTTCAGTAAAGATAGATTCCCACAAAGTTGTGCAATGTCATTATATGACA
CCTTGCACTCTTACCGTCTTGACAGAAGCCAAGTAAGGAACTGAAGTTGTATCTGACTGTAGGGTGAATGTCTGAGGCCTGCCTCC
TAATAAAGACTCAAGGAGGAAGTCAATTGGGCATCTGCTAATAGAATGAACTCATGATGGAAACTTCAGTTCATTTACTTTGTCCT
GAAAATTCCCTGGTTCTGTTCCATTTTGAGCGAAATTGGCCTTGGGAAAAACCACGTTCTTCCTTTCCGATTCTTCATCCGGTCTA
CGCTATGCAATTCCTCCCCAAATATAGATCTTATTTCTGCTCATTTCCCCTACTTATTAAAATCACACCAAACACTTACTATTTC
TTATCTCTTTCACTTTTTAAATATCTTTCACCAGGTTATATTTTGGTATTATTTTTCCAAACATTTTAAGCACTGAATATCGAAC
AAGCACTCAAATTGAAGTATCAGTCATGTTTTGTGTATTTTTCGCTGATAAAAATTATTTAACATTTATATTTTTACTTGATTACA
TATGCACATGTATGTAAATGTAAAATACTAATATTCACTAATATATGTACATAATGATCAATTGGTTTAACTTCTTTTATGTAAGT
ATGGTATATAAATTTCAAGACGAAAAAAAAAAAAAAAAAAAAAAAAAAAAAAAAAAAAAAAAAAAAAAAAAAAAAAAAAAAAA

16 GATCACTTACAATCTGACAACACTTACAATCTACTCAGAACAACCTCTCTCTCTCCAGCAGAGAGTGTCACCTCCTGCTTTAGGAC
CATCAAGCTCTGCTAACTGAATCTCATCCTAATTGCAGGATCACATTGCAAAGCTTTCACTCTTTCCCACCTTGCTTGTGGGTAAA
TCTCTTCTGCGGAATCTCAGAAAGTAAAGTTCCATCCTGAGAATATTTCACAAAGAATTTCCTTAAGAGCTGGACTGGGTCTTGAC
CCCTGAATTTAAGAAATTCTTAAAGACAATGTCAAATATGATCCAAGAGAAAATGTGATTTGAGACTGGAGACAATTGTGCATATC
GTCTAATAATAAAAACCCATACTAGCCTATAGAAAACAATATTTGAAAGATTGCTACCACTAAAAAGAAAACTACTACAACTTGAC
AAGACTGCTGCAAACTTCAATTTGTCAACCACAACTTGACAAGGTTGCTATAAAACAAGATTGCTACAACTTCTAGTTTATGTTAT
ACAGCATATTTCATTTTGGCTTAATGATGGAGAAAAAGTGTACCCTGTATTTTCTGGTTCTCTTGCCTTTTTTTATGATTCTTGTT
ACAGCAGAATTAGAAGAGAGTCCTGAGGACTCAATTCAGTTGGGAGTTACTAGAAATAAAATCATGACAGCTCAATATGAATGTTA
CCAAAAGATTATGCAAGACCCCATTCAACAAGCAGAAGGCGTTTACTGCAACAGAACCTGGGATGGATGGCTCTGCTGGAACGATG
TTGCAGCAGGAACTGAATCAATGCAGCTCTGCCCTGATTACTTTCAGGACTTTGATCCATCAGAAAAAGTTACAAAGATCTGTGAC
CAAGATGGAAACTGGTTTAGACATCCAGCAAGCAACAGAACATGGACAAATTATACCCAGTGTAATGTTAACACCCACGAGAAAGT
GAAGACTGCACTAAATTTGTTTTACCTGACCATAATTGGACACGGATTGTCTATTGCATCACTGCTTATCTCGCTTGGCATATTCT
TTTATTTCAAGAGCCTAAGTTGCCAAAGGATTACCTTACACAAAAATCTGTTCTTCTCATTTGTTTGTAACTCTGTTGTAACAATC
ATTCACCTCACTGCAGTGGCCAACAACCAGGCCTTAGTAGCCACAAATCCTGTTAGTTGCAAAGTGTCCCAGTTCATTCATCTTTA
CCTGATGGGCTGTAATTACTTTTGGATGCTCTGTGAAGGCATTTACCTACACACACTCATTGTGGTGGCCGTGTTTGCAGAGAAGC
AACATTTAATGTGGTATTATTTTCTTGGCTGGGGATTTCCACTGATTCCTGCTTGTATACATGCCATTGCTAGAAGCTTATATTAC
AATGACAATTGCTGGATCAGTTCTGATACCCATCTCCTCTACTATCATGGCCCAATTTGTGCTGCTTTACTGGTGAATCTTTT
TTTCTTGTTAAATATTGTACGCGTTCTCATCACCAAGTTAAAAGTTACACACCAAGCGGAATCCAATCTGTACATGAAAGCTGTGA
GAGCTACTCTTATCTTGGTGCCATTGCTTGGCATTGAATTTGTGCTGATTCCATGGCGACCTGAAGGAAAGATTGCAGAGGAGGTA
TATGACTACATCATGCACATCCTTATGCACTTTCAGGGTCTTTTGGTCTCTACCATTTTCTGCTTCTTTAATGGAGAGGTTCAAGC
AATTCTGAGAAGAAACTGGAATCAATACAAAATCCAATTTGGAAACAGCTTTTCCAACTCAGAAGCTCTTCGTAGTGCGTCTTACA
CAGTGTCAACAATCAGTGATGGTCCAGGTTATAGTCATGACTGTCCTAGTGAACACTTAAATGGAAAAAGCATCCATGATATTGAA
AATGTTCTCTTAAAACCAGAAATTTATATAATTGAAAATAGAAGGATGGTTGTCTCACTGTTTTGTGCTTCTCCTAACTCAAGGA
CTTGGACCCATGACTCTGTAGCCAGAAGACTTCAATATTAAATGACTTTTTGAATGTCATAAAGAAGAGCCTTCACATGAAATTAG
TAGTGTGTTGATAAGAGTGTAACATCCAGCTCTATGTGGGAAAAAAGAAATCCTGGTTTGTAATGTTTGTCAGTAAATACTCCCAC
TATGCCTGATGTGACGCTACTAACCTGACATCACCAAGTGTGGAATTGGAGAAAAGCACAATCAACTTTTCTGAGCTGGTGTAAGC
CAGTTCCAGCACACCATTGCATGAATTCACAAACAAATGGCTGTAAAACTAAACATACATGTTGGGCATGATTCTACCCTTATTGC
CCCAAGAGACCTAGCTAAGGTCTATAAACATGAAGGGAAATTAGCTTTTAGTTTTAAAACTCTTTATCCCATCTTGATTGGGGCA
GTTGACTTTTTTTTGCCCAGAGTGCCGTAGTCCTTTTTGTAACTACCCTCTCAAATGGACAATACCAGAAGTGAATTATCCCTGC
TGGCTTTCTTTTCTCTATGAAAAGCAACTGAGTACAATTGTTATGATCTACTACTCATTTGCTGACACATCAGTTATATCTTGTGGCAT
ATCCATTGTGGAAACTGGATGAACAGGATGTATAATATGCAATCCTACTTCTATATCATTAGGAAAACATCTTAGTTGATGCTACA
AAACACCTTGTCAACCTCTTCCTGTCTTACCAAACAGTGGGAGGGAATTCCTAGCTGTAAATATAAATTTTGTCCCTTCCATTTCT
ACTGTATAAACAAATTAGCAATCATTTTATATAAAGAAAATCAATGAAGGATTTCTTATTTTCTTGGAATTTTGTAAAAAGAAATT
GTGAAAAATGAGCTTGTAAATACTCCATTATTTTATTTTATAGTCTCAAATCAATACATCAACCTATGTAATTTTAAAGCAAA
TATATAATGCAACAATGTGTGTATGTTAATATCTGATACTGTATCTGGGCTGATTTTTAAATAAAATAGAGTCTGAATGCTA

17 ATGCCGGAAGCTTTCCTGCCACGCAAGCTTTCCGAGCATGCTAACTCGCCCCAAGCAGCTCCCATCCCGCAGCATCCACTGCAGCC
GCTGAGGAGAGTGGCGCAGCGCAGAAACCAGTGCCCAGTGCCCAGTGGGGAAGCGGTCCGTGGGAGTCACTCCCCAGCGGCCGC
CGCGGGCCGAAGCAGCTGCAGCGGGCGCGGCCCCGGGTCTGCGGGCGAGCGCACCGGCAGGGGTCGAGCTCGCGTCCCGTCCC
CGCCCCCTGCGCGTGGCGCAGCAGGAATTTGGCCGGGACCCGGGCGTATTCGCGGCTGCTGACTCGCGGCGGCCGGCTGCCTT
TCGCTCATCTCTATTCTGGGGCCGTTGGGTCACCGCGCTCCGCCGGCCCCCTCCCCCGGGCCCGGAGGGTGTGTCCCCCGCTCCGG
GGCTCGCCGCGCCTATAAGGGGCCGAGCGGCGGCAGGACATGCAGCTCTACAGCAGCGCTCTGCACCCACTACCCCGCCGGGGCC
CCGGGTCCCACGGCGCCGCCCCCGCGCACCGCCGCGCGCTACCCCCTTCAAGGTCTCGCTGCAGCCCCCGGGACGCGCGCGC
CGCGCCCGAGCCCGAGACCGGTGAGTGCCAGCCCGCCGCGGCCGCCGAGCACCGGGAAGCCGCCGCTGTCCCCGCCGCCAAGATGC
CCGCCTTCCTCCTGCTTCGAGGTGGTGTCCGGGGCCGCCGCGCCCGCCTCCGCCGCCGCCGGCCCGCCCGGCGCGTCCTGCAAG
CCGCCGCTGCCGCCGCACTACACGTCCACCGCACAGATCACCGTGCGGGCCCTGGGCGCCGACAGGCTCCTGCTGCACGGGCCCGA
TCCCGTTCCCGGCGCCGCGGGCTCCGCCGCTGCCCCGCGCGGCCGCTGCCTCCTGCTCGCCCCGGCGCCCGCAGCCCCGGTCCCGC

TABLE 1-continued

Sequences Table. First column: SEQ ID No. Second column: corresponding mRNA sequence. For the 3 different groups, see explanation in the text.

| | |
|---|---|
| | CGCGGCGGGGCTCCTCGGCCTGGCTCCTGGAGGAGCTGCTGCGGCCCGACTGCCCCGAGCCCGCGGGCTTGGACGCGACACGGGAG<br>GGGCCCGATCGGAACTTCCGACTGAGCGAGCACCGCCAGGCCCTGGCCGCCGCCAAGCACCGAGGCCCCGCGGCGACCCCGGGGAG<br>CCCCGATCCCGGCCCCGGTCCGTGGGGCGAAGAGCACTTGGCGGAGAGGGGCCCCAGGGGCTGGGAGAGGGGCGGCGATCGCTGCG<br>ACGCGCCCGGTGGGGACGCGGCGCGGAGGCCCGACCCAGAGGCCGAGGCACCCCCCGCCGGGAGCATGCAGGCGCGCCCCGAGTAGT<br>GCGGCGGAGCCGGTGATCGTCTCCAGGTCGGATCCCAGAGACGAGAAGCTGGCCCTATACCTGGCCGAGGTGGAGAAGCAGGACAA<br>GTATCTGCGGCAGAGGAATAAGTACCGATTCCACATCATTCCAGACGGCAACTGCCTCTACCGAGCTGTCAGCAAGACGGTGTATG<br>GGGACCAGAGCCTGCACCGGGAGTTGAGGGAGCAGACGGTGCACTACATCGCCGACCATCTCGACCACTTCAGCCCCCTGATTGAG<br>GGCGACGTGGGGGAGTTTATCATCGCTGCTGCCCAAGACGGGGCATGGGCCGGGTACCCGGAGTTGCTGGCCATGGGGCAGATGCT<br>GAATGTGAATATCCATTTAACTACTGGAGGGAGGCTGGAGAGTCCCACGGTGTCTACCATGATTCATTATTTGGGCCACAGGGATT<br>CCCTGAGGCCTAGTATTTGGCTCAGTTGGCTCAGTAACGGACACTATGATGCTGTATTTGATCACTCCTATCCTAACCCAGAGTAC<br>GACAACTGGTGCAAACAAACTCAAGTGCAAGGAAACGCGACGAAGAACTTGCCAAATCTATGGCCATATCCTTGTCTAAAATGTA<br>TATTGAACAAAATGCATGCTCTTGAAATGTCTCAAAACCTTACACCCTGGGAATAATTGCATATATAACTTGTGTTTGGAGAATCA<br>CATGAACTTTAATCAGGGTAATAGCACTTTCAAACTTGCTAGGTGATTTACTGTAGGTGTAATGCCTTAATCATCTTTTTGAATG<br>TTTTCTCAGAGCTGGAGGTTGCTGGGCACCTAAATGATGTTTCATGATAGCTTTGGGTGATTTTACTGCTATTTATAATTTGCTGT<br>ATAAAGTGAGCATTACTTAATTTGCAAGCTGATTTCTCACAGTGTAAATTTGTTCATTCCTGGTAGTCTATTTTCTATAAAAATGT<br>ATTTTTTGCACAACATTTTTAAAAACTGGTGTACCTTCATCTATGACGTGTTCCATTTTGACAAACAGCTTTCAGGCGTAAATCCAG<br>AGAAGTGCTTTATATGAAATGTATTATTTTGAACAGAGTTTGTGATTTGGTAGTTATTTTATGTTGTTGAAATTTGAATTTCACAA<br>TTCTTAGATAATTATTTCAAATGGATATTGATGCATTCTTGTTACCAGATGTTTGGCCCATTCCATTTTGATGAAACAGAGCTGTT<br>GTTTTGGAAGTCATTATTTTCTAGAAATGGCGAATCTTTTAAAGAAAATTACTTAATGGAAGGTTGTGGGAAGGTGTTTTTTTGT<br>GTTTTTTTTTTGGTTTTTGTTTTGTTTTTCCTCTTTTAAGGGATAGTAGCAGGTCTTACTTGAATGAAAGTCTGATATTTGCTGAT<br>GGCAGAATGATTATTCTGTACCCTGGTTGATGTGTAGAGTAGATTGTCTGGTGCTCTCAGTTGTTTTTATTTACATTTGTCACGTT<br>GTTGTAAGAGAATGTTAACATGGTATAAAACTCTGTGACAAGATAAGCCTCCTGCTTTATATAACTTCTTGAATCCAGCTAAGAGA<br>TTTATAAACTAATGGCATAAATGTCTGGAGCCAACCTTGGCAGTTATAGCAGGAGAACACTGTCTTAATATTTCTTTACATTCTTT<br>CAAAAGGCAAAATAGGATTGCCCTGTATTGATGTAGAAATGTCTGTAAACAGAGCTTGTATGGTTTGCTGGGTCAAACAATGTTTC<br>CAACTTAAAATCAATCTCATTGCCACTTTAACTACTTTTACTCATATTATTAAGTAATGCAGTTTGTACTTTTTTTTATTTTGTAA<br>CATTTTGTGATTTTTTTGTACAAAACTGTATTTGTACAATAGAGCAATTCCCAGCTGATGGAATGAATGAATAAAATGCAAAATTA<br>TACTTTTACAATGCCTTTTTGGATAGAGTGGTTTTTAAATTGTGATGTTTGTAGGAAACTTTCTTGCATGTATGCATGTACACAAT<br>TTTTTTTTTCCATAAAGATGCACAGCAATAGAGAGGTTTCCTAAATTATCACATGAAGAGGATAGGCTAATCATGAGTAATTTCA<br>AAGGATAAGTCTGAATAAAATATAATTTAAAAGTG |
| 18 | CTTCGCCACATTCGCTTCCTGCTTTCGGTGTGTCTGTTGTGTCTTGTTGCGGGCACCGCAGTCGCCGTGAAGATGGCGTCTACCAG<br>CCGTTTGGATGCTCTTCCAAGAGTCACATGTCCAAACCATCCAGATGCGATTTTAGTGGAGGACTACAGAGCCGGTGATATGATCT<br>GTCCTGAATGTGGCTTGGTTGTAGGTGACCGGGTTATTGATGTGGGATCTGAATGGCGAACTTTCAGCAATGACAAAGCAACAAAA<br>GATCCATCTCGAGTTGGAGATTCTCAGAATCCTCTTCTGAGTGATGGAGATTTGTCTACCATGATTGGCAAGGGCACAGGAGCTGC<br>AAGTTTTGACGAATTTGGCAATTCTAAGTACCAGAATCGGAGAACAATGAGCAGTTCTGATCGGGCAATGATGAATGCATTCAAAG<br>AAATCACTACCATGGCAGACAGAATCAATCTACCTGAAATATAGTTGATCGAACAAATAATTTATTCAAGCAAGTATATGAACAG<br>AAGAGCCTGAAGGGAAGAGCTAATGATGCTATAGCTTCTGCTTGTCTCTATATTGCCTGTAGACAAGAAGGGGTTCCTAGGACATT<br>TAAAGAAATATGTGCCGTATCACGAATTTCTAAGAAAGAAATTGGTCGGTGTTTTAAACTTTATTTGAAAGCGCTAGAAACCAGTG<br>TGGATTTGATTACAACTGGGGACTTCATGTCCAGGTTCTGTTCCAACCTTTGTCTTCCTAAACAAGTACAGATGGCAGCTACACAT<br>ATAGCCCGTAAAGCTGTGGAACTGGACTTGGTTCCTGGGAGGAGCCCCATCTCTGTGGCAGCGGCAGCTATTTACATGGCCTCACA<br>GGCATCAGCTGAAAAGAGGACCCAAAAAGAAATTGGAGATATTGCTGGTGTTGCTGATGTTACAATCAGACAGTCCTATAGACTGA<br>TCTATCCTCGAGCCCCAGATCTGTTTCCTACAGACTTCAAATTTGACACCCCAGTGGACAAACTACCACAGCTATAAATTGAGGCA<br>GCTAACGTCAAATTCTTGAATACAAAACTTTGCCTGTTGTACATAGCCTATACAAAATGCTGGGTTGAGCCTTTCATGAGGAAAA<br>CAAAAGACATGGTACGCATTCCAGGGCTGAATACTATTGCTTGGCATTCTGTATGTATATACTAGTGAAACATATTTAATGATTTA<br>AATTTCTTATCAAATTTCTTTTGTAGCAATCTAGGAAACTGTATTTTGGAAGATATTTGAAATTATGTAATTCTTGAATAAAACAT<br>TTTTCAAAACTCAA |
| 19 | GGCAGTTAGCCCGCCCGCTCGGCGCAGGGCGTGGCTTCTCGTAGCCATTAGGAAACAGCAACCCTTTCACCTCAGTTTTCTTCACT<br>CCGGCATTTGCAGCAGAGCGAAAGGTGGTCGAGTCCTGAAGGAGGGCCTGATGTCTTCATCATTCTCAAATTCTTGTAAGCTCTGC<br>GTCGGGTGAAACCAGACAAAGCCGCGAGCCCAGGGATGGGAGCACGCGGGGACGGCCTGCCGGCGGGGACGACAGCATTGCGCCT<br>GGGTGCAGCAGTGTGCGTCTCGGGGAAGGGAAGATATTTTAAGGCGTGTCTGAGCAGACGGGGAGGCTTTTCCAAACCCAGGCAGC<br>TTCGTGGCGTGTCGGTTTCGACCCGGTCACACAAAGCTTCAGCATGTCATGTGAGGACGGTCGGGCCCTGGAAGGAACGCTCTCG<br>GAATTGGCCGCGGAAACCGATCTGCCCGTTGTGTTTGTGAAACAGAGAAAGATAGGCGGCCATGGTCCAACCTTGAAGGCTTATCA<br>GGAGGGCAGACTTCAAAAGCTACTAAAAATGAACGGCCCTGAAGATCTTCCAAGTCCTATGACTATGACCTTATCATCATTGGAG<br>GTGGCTCAGGAGGTCTGGCAGCTGCTAAGGAGGCAGCCCAATATGCAAGAAGGTGATGGTCCTGGACTTTGTCACTCCCACCCCT<br>CTTGGAACTAGATGGGGTCTCGGAGGAACATGTGTGAATGTGGGTTGCATACCTAAAAAACTGATGCATCAAGCAGCTTTGTTAGG<br>ACAAGCCCTGCAAGACTCTCGAAATTATGGATGGAAAGTCGAGGAGACAGTTAAGCATGATTGGGACAGAATGATAGAAGCTGTAC<br>AGAATCACATTGGCTCTTTGAATTGGGGCTACCGAGTAGCTCTGCGGGAGAAAAAGTCGTCTATGAGAATGCTTATGGGCAATTT<br>ATTGGTCCTCACAGGATTAAGGCAACAAATAATAAAGGCAAAGAAAAAATTTATTCAGCAGAGAGATTTCTCATTGCCACTGGTGA<br>AAGACCACGTTACTTGGGCATCCCTGGTGACAAAGAATACTGCATCAGCAGTGATGATCTTTTCTCCTTGCCTTACTGCCCGGGTA<br>AGACCCTGGTTGTTGGAGCATCCTATGTCGCTTTGGAGTGCGCTGGATTTCTTGCTGGTATTGGTTTAGACGTCACTGTTATGGTT<br>AGGTCCATTCTTCTTAGAGGGATTTGACCAGGACATGGCCAACAAAATTGGTGAACACATGGAAGAACATGGCATCAAGTTTATAAG<br>ACAGTTCGTACCAATTAAAGTTGAACAAATTGAACAGGGACACCAGGGTAGTTAGCTCAGTCTCACCAATAGTGAGG<br>AAATCATTGAAGGAGAATATAATACGGTGATGCTGGCAATAGGAAGAGATGCTTGCACAAGAAAAATTGGCTTAGAAACCGTAGGG<br>GTGAAGATAAATGAAAAGACTGGAAAAATACCTGTCACAGATGAAGAACAGACCAATGTGCCTTACATCTATGCCATTGGCGATAT<br>ATTGGAGGATAAGGTGGAGCTCACCCCAGTTGCAATCCAGGCAGGAAGATTGCTGGCTCAGAGGCTCTATGCAGGTTCCACTGTCA<br>AGTGTGACTATGAAATGTTCCAACCACTGTATTTACTCCTTTGGAATATGGTGCTTGTGGCCTTTCTGGAGGAAAGCTGTGGAG<br>AAGTTTGGGGAAGAAAATATTGAGGTTTACCATAGTTACTTTTGGCCATTGGAATGGACGATTCCGTCAAGAGATAACAACAAATG<br>TTATGCAAAAATAATCTGTAATACTAAAGACAATGAACGTGTTGTGGGCTTTCACGTACTGGGTCCAAATGCTGGAGAAGTTACAC<br>AAGGCTTTGCAGCTGCGCTCAAATGTGGACTGACCAAAAAGCAGCTGGACAGCACAATTGGAATCCACCCTGTCTGTGCAGAGGTA<br>TTCACAACATTGTCTGTGACCAAGCGCTCTGGGGCAAGCATCCTCCAGGCTGGCCTTGGAGGTTAAGCCCCAGTGTGGATGCTGTT<br>GCCAAGACTGCAAACCACTGGCTCGTTTCCGTGCCCAAATCCAAGGCGAAGTTTTCTAGAGGGTTCTTGGGCTCTTGGCACCTGCG<br>TGTCCTGTGCTTACCACCGCCAAGGCCCCCTTGGATCTCTTGGATAGGAGTTGTGAATAGAAGGCAGGCAGCATCACACTGGG<br>TCACTGACAGACTTGAAGCTGACATTTGGCAGGGCATCGAAGGGATGCATCCATGAAGTCACCAGTCTCAAGCCCATGGGTAGGC<br>GGTGATGGAACAACTGTCAAATCAGTTTTAGCATGACCTTTCCTTGTGGATTTTCTTATTCTCGTTGTCAAGTTTTCTAGGGTTGA<br>ATTTTTTCTTTTTTCTCCATGGTGTTAATGATATTAGAGATGAAAAACGTTAGCAGTTGATTTTTGTCCAAAAGCAAGTCATGGC |

TABLE 1-continued

Sequences Table. First column: SEQ ID No. Second column: corresponding mRNA sequence. For the 3 different groups, see explanation in the text.

```
   TAGAGTATCCATGCAAGGTGTCTTGTTGCATGGAAGGGATAGTTTGGCTCCCTTGGAGGCTATGTAGGCTTGTCCCGGGAAAGAGA
   ACTGTCCTGCAGCTGAAATGGACTGTTCTTTACTGACCTGCTCAGCAGTTTCTTCTCTCATATATTCCCAAAACAAGTACATCTGC
   GATCAACTCTAGCCAAATTTGCCCCTGTGTGCTACATGATGGATGATTATTATTTTAAGGTCTGTTTAGGAAGGGAAATGGCTACT
   TGGCCAGCCATTGCCTGGCATTTGGTAGTATAGTATGATTCTCACCATTATTTGTCATGGAGGCAGACATACACCAGAAATGGGGG
   AGAAACAGTACATATCTTTCTGTCTTTAGTTTATTGTGTGCTGGTCTAAGCAAGCTGAGATCATTTGCAATGGAAAACACGTAACT
   TGTTTAAAAGTTTTTCTGGTAGCTTTAGCTTTATGCTAAAAAAAATAATGACATTGGGTATCTATTTCTTTCTAAGACTACATTAG
   TAGGAAAATAAGTCTTTTCATGCTTATGATTTAGCTGTTTTGTGGTAATTGCTTTTTAAAGGAAGTTATTAATATCATAAGTTATT
   ATTAATATTTTGAACACAGGTGGATGTGAAGGATTTTCATTTAAAAACCAAGTGGTTTTGACTTTTTCTGTTGAATGAACAACTGT
   GCCTTGTGGAATTTTTGCAGAAGTGTTTATGCTTTGTTAGCATTTCAACTTGCATTATTATAAAGAGGTATTAATGCCTCAGTTAT
   GTGTTTGTCAATGTACTGGCTGAGGATTCTATCTCAGCTGTCTTTTCTAACTGTGTAGGTTGAGTTTTGAACACGTGCTTGTGGAC
   ATCAGGCCTCCTGCCAGCAGTTCTTGAAGCTTCTTTTTCATTCCTGCTACTCTACCTGTATTTCTCAGTTGCAGCACTGAGTGGTC
   AAAATACATTTCTGGGCCACCTCAGGGAACCCATGCATCTGCCTGGCATTTAGGCAGCAGAGCCCCTGACCGTCCCCCACAGGGCT
   CTGCCTCACGTCCTCATCTCATTTGGCTGTGTAAAGAAATGGGAAAAGGGAAAAGGGAGAGACCAATTGAGGCAGTTGACCATATTC
   AGTTTTATTTATTTATTTTTAATTTGTTTTTTTCTCCAAGTCCACCAGTCTCTGAAATTAGAACAGTAGGCGGTATGAGATAATCA
   GGCCTAATCATGTTGTGATTCTCTTTTCTTAGTGGAGTGGAATGTTCTATCCCCACAAGAAGGATTATATCTTATAGACTTGTCTT
   GTTCAGATTCTGTATTTACCCATTTTATTGAAACATATACTAAGTTCCATGTATTTTTGTTACAAATCTTCTGAAAAAAACAAAA
   CAATGTGAAACATTAAAATTAAAAGGCATTAATAATAAAAAAAAAAAAAAAAA

20 GCCTTAGCTCCCGCGCTAGAGAGAAACATGTATCGTTTTCGATCACAGCTCTTCACGGGGATTTCTGCTGCCGCCACCGCCCACTC
   TTACCCCCGCCGCTTCTCGACTCTGTTGTTAGCCGAAGACTCGCCTCTCAGCCGCCCGCCGCCACAGACGCACGAGTAAAAAGTGCA
   GCTCCATCGGCTGATCCTCGCTAAGCTCCGACTCTGGGCGGCACCGGGCGTCCACGATGCCGAAGAACAAGAAGCGGAACACTCC
   CCACCGCGGTAGCAGTGCTGGCGGCGGCGGGTCAGGAGCAGCCGCAGCGACGGCGGCAGCAGGTGGCCAGCATCGAAATGTTC
   AGCCTTTTAGTGATGAAGATGCATCAATTGAAACAATGAGCCATTGCAGTGGTTATAGCGATCCTTCCAGTTTTGCTGAAGATGGA
   CCAGAAGTCCTTGATGAGGAAGGAACTCAAGAAGACCTAGAGTACAAGTTGAAGGGATTAATTGACCTAACCCTGGATAAGAGTGC
   GAAGACAAGGCAAGCAGCTCTTGAAGGTATTAAAAATGCACTGGCTTCAAAAATGCTGTATGAATTTATTCTGGAAAGGAGAATGA
   CTTTAACTGATAGCATTGAACGCTGCCTGAAAAAAGGTAAGAGTGATGAGCAACGTGCAGCTGCAGCGTTAGCATCTGTTCTTTGT
   ATTCAGCTGGGCCCTGGAATTGAAAGTGAAGAGATTTTGAAAACTCTTGGACCAATCCTAAAGAAAATCATTTGTGATGGGTCAGC
   TAGTATGCAGGCTAGGCAAACTTGTGCAACTTGCTTTGGTGTTTGCTGTTTTATTGCCACAGATGACATTACTGAACTATACTCAA
   CTCTGGAATGTTTGGAAAATATCTTCACTAAATCCTATCTCAAAGAGAAAGACACTACTGTTATTTGCAGCACTCCTAATACAGTG
   CTTCATATCAGCTCTCTTCTTGCATGGACACTACTGCTGACCATATGCCCAATCAATGAAGTGAAGAAAAAGCTTGAGATGCATTT
   CCATAAGCTTCCAAGCCTCCTCTCTTGTGATGATGTAAACATGAGAATAGCTGCTGGTGAATCTTTGGCACTTCTCTTTGAATTGG
   CCAGAGGAATAGAGAGTGACTTTTTTATGAAGACATGGAGTCCTTGACGCAGATGCTTAGGGCCTTGGCAACAGATGGAAATAAA
   CACCGGGCCAAAGTGGACAAGAGAAAGCAGCGGTCAGTTTTCAGAGATGTCCTGAGGGCAGTGGAGGAACGGGATTTTCCAACAGA
   AACCATTAAATTTGGTCCTGAACGCATGTATATTGATTGCTGGGTAAAAAAACACACCTATGACACCTTTAAGGAGGTTCTTGGAT
   CAGGGATGCAGTACCACTTGCAGTCAAATGAATTCCTTCGAAATGTATTTGAACTTGGACCCCCAGTGATGCTTGATGCTGCAACG
   CTTAAAACGATGAAGATTTCTCGTTTCGAAAGGCATTTATATAACTCTGCAGCCTTCAAAGCTCGAACCAAAGCTAGAAGCAAATG
   TCGAGATAAGAGAGCAGATGTTGGAGAATTCTTCTAGATTTTCAGAACTTGAAGACTATTTTCTAATTTCTATTTTTTTTTCTATT
   TCAATGTATTTAAACTCTAGACACAGTTTTTATCCTGGATTAACTTAGATAACTTTTGTAGCAGTGGTTATATTGCTTATAATTTA
   ATGTACAATACTATTGAAACTGGTGAGTTCTGATTATTAAATATTCTCTGTAAATCAGTAAACATGTATAAAGTATTTGTAATGTT
   TGGTCATAATTTATTTATGAAGACAGCAAAAGACTGATTTCATGATGGGGAAAACAATTAGCCAAAGTTTAATTTCTTACACTCTG
   GTTGTCAAGAATACTGATTTACTATAATGATATATACATGCAAGATATTTAACTTAATATCTTAGACAAGAGTTCTGGGTACAATT
   TTGGGATCTAGTTCCCCTGGAAAAGCTGCTGTATTTTTAATTTTTAATGGAATGTAGCTTTTAAAATCCTGTCACTGGCATCAACA
   AAAGGAATTATACCATGAGACCTTATAGCTGTACTTAAAAGCCATTCAGTTCAGCTATTGGGAGTTCATGATGAATTAGCATATGC
   CAGAAAGGTTGCTAACCTTAACATCTGAGAGCAGTAACACTGATTTTATCTGCTGTATGAGACTTTGTGCATTTTACTTTGAAATA
   AAGATTTTTTCCACACTGAAAAAAAAAAAAAAAAAAA

21 AGAGGTGCCCTCGGTGATAGAGGAAACATGGCCGAGTATACGCGGCTGCACAACGCCTTGGCGCTAATCCGCCTCCGAAACCCGCC
   GGTCAACGCGATCAGTACGACTTTACTCCGTGACATAAAGAAGGACTACAGAAAGCTGTAATAGACCATACAATAAAAGCCATTG
   TGATTTGTGGAGCAGAGGGCAAATTTTCTGCAGGTGCTGATATTCGTGGCTTCAGTGCTCCTAGGACATTTGGCCTTACACTGGGA
   CATGTAGTAGATGAAATACAGAGAAATGAGAAGCCCGTGGTGGCAGCAATCATGGCATGGCTTTCGGAGGGGGACTAGAGCTGGC
   CCTGGGCTGTCACTATAGGATTGCCCACGCAGAGGCTCAAGTTGGCCTTACCAGAAGTTACACTGGGACTTCTCCCTGGTGCAAGAG
   GAACCCAGCTTCTCCCCAGACTCACTGGAGTTCCTGCTGCACTTGACTTAATTACCTCAGGAAGACGTATTTTAGCAGATGAAGCA
   CTCAAGCTGGGCATTCTAGATAAAGTTGTAAACTCAGACCCGGTTGAAGAAGCAATCAGATTTGCTCAGAGAGTTTCAGATCAACC
   TCTAGAATCCCGTAGACTCTGCAACAAGCCAATTCAGAGCTTGCCCAACATGGACAGCATTTTTAGTGAGGCCCTCTTGAAGATGC
   GGAGGCAGCACCCTGGGTGTCTTGCACAGGAGGCTTGTGTCCGTGCAGTCCAGGCTGCTGTGCAGTATCCCTATGAAGTGGGCATC
   AAGAAGGAGGAGGAGCTGTTTCTATATCTTTTGCAATCAGGGCAGGCTAGAGCCCTGCAATATGCTTTCTTCGCTGAAAGGAAAGC
   AAATAAGTGGTCAACTCCCTCCGGAGCATCGTGGAAAACAGCATCAGCGCGGCCTGTCTCCTCAGTTGGTGTTGTTGGCTTGGGAA
   CAATGGGCCGAGGCATTGTCATTTCTTTTGCAAGGGCCAGGATTCCTGTGATTGCTGTAGACTCGGACAAAAACCAGCTAGCAACT
   GCAAACAAGATGATAACCTCTGTCTTGGAAAAAGAAGCCTCCAAAATGCAACAGAGCGGCCACCCTTGGTCAGGACCAAAACCCAG
   GTTAACTTCATCTGTGAAGGAGCTTGGTGGTGTAGATTTAGTCATTGAACAGTATTTGAGGAAATGAGCCTGAAGAAGCAGGTCT
   TTGCTGAACTCTCAGCTGTGTGCAAACCAGAAGCATTTTTGTGCACTAATACTTCAGCCCTGGATGTTGATGAGATTGCTTCTTCC
   ACTGATCGTCCTCACTTGGTCATTGGCACCCACTTCTTTTCGCCAGCTCATGTCATGAAGTTGTTAGAGGTTATTCCCAGCCAATA
   CTCTTCCCCCACTACCATTGCCACTGTTATGAACTTATCAAAAAAGATTAAAAAGATTGGAGTCGTTGTAGGCAACTGTTTTGGAT
   TTGTGGGGAATCGAATGTTGAATCCTTACTACAATCAGGCATATTTCTTGTTAGAAGAAGGCAGCAAACCAGAGGAGGTAGATCAG
   GTGCTGGAAGAGTTTGGTTTTAAAATGGGACCTTTTAGAGTGTCTGATCTTGCTGGGTTGGATGTGGGCTGGAAATCTAGAAAGGG
   GCAAGGTCTTACTGGACCTACATTGCTTCCAGGAACTCCTGCCCGAAAAGGGGTAATAGGAGGTACTGCCCAATTCCTGATGTGC
   TCTGTGAATTGACGATTTGGCCAGAAGACAAGGTAAGGGTTGGATCTCAATATGACAAGCCATTGGGTAGGATTCACAAACCTGAT
   CCCTGGCTTTCCAAATTCCTATCACGGTATAGAAAAACCCATCACATTGAACCACGTACCATTAGCCAGGATGAGATCCTTGAACG
   CTGCTTATATTCACTTATCAATGAAGCATTCCGTATCTTGGGAAGGGATAGCTGCTAGCCCAGAGCACATTGATGTTGTCTATT
   TACATGGATATGGATGGCCAAGGCACAAGGGCGGGCCCATGTTCTATGCTTCCACAGTTGGGTTGCCCACAGTTCTAGAGAAATTG
   CAGAAATATTACAGGCAGAACCCTGATATTCCCCAACTGGAACCAAGTGACTTAAAAACTGGCTTCTCAAAAACCCTCC
   CCTGAAAGAATGGCAAAGCTTGGCAGGCTCCCCTAGCAGTAAATTGTGATTCAGTCTTCCAGATTATGCCTCACATGCTAGCATCA
   GGTAATGCTGACTGAATTTCAGTGAAATTAAATCAAAAATCCAAAGTAAGATTGTTCTGAAATACAAAGCAAAATAAATAATCATT
   AGAATCTTCTGTGTAACGACTCTAATGGTCAAATCTTTAGGAATGTGCTTCCTATGCCTCTGAATCTGTCCTTATCAGATAAATTC
   AATGCATGAACTTGTGTGAATATAATACCATAATAGCTAATGAAAGAGGCTCAGGCATAAGTTGAGATTTTCAAATGCTTTTATCA
   TTGGATAAATGTGTCATCAATTAATAAATGATAAATGCAGCTAAGTCATACATTCATTTGACTCCTTTCAATGTCACACACATAG
```

TABLE 1-continued

Sequences Table. First column: SEQ ID No. Second column: corresponding mRNA sequence. For the 3 different groups, see explanation in the text.

```
   TATTGATCAGAAATCTTATGAATCATACATACACTCAACAAACATTAAAGTTGTAGGAAAAAGACAGTTGGAAATTGGTAAGGGAA
   CTGAGTACTTCAAACCAGCACAGGGAACTTAGGTTAGTGTGGCAAGCTTTCCTCTTCTGGTCTTTCCTCTTCTGTTTATGGAGAA
   ATAATAGAAAGTAGTAAGTCGTTAACTTAGTGTAAGAAGGGTCTTAGAGAACATCTAACCTTCTAGGATTTCCCAATTCTGTGATA
   GAGTAATGACACCAGTTTTCCTGTCATGACAAGCCTCTGTGATGTACATATGGAAATGGTTGAATCTTGAAAAATCTAAAATTGT
   TGCAAAACATATTTTGTATGATTTTGTTGTAAGAGTTCTTCTCTTTTTACTTTTTGCCTTGTGTAGTTAAAAATTAAGGGGCTGGT
   CAATACAAAAACTTGTACACAAATATTTATAGCAGAATTATTCATAATGGCCAAAAGCTGAATACAACCCAAATGTCTATGAACTA
   ATGAATAGATAAACCAAATCTGGTATATCCATACAATGGACTATATTATTCAGCCATAAAAAGAAATAAAGGGCCAGGCACAGTGG
   CTCACACCTGTAATCCCAGCACTTTGGGAGGCTGAGGCAGGAGGATTGTTTGAGGCCAGAAATTTGAGACCAGCCTGGGCAACATA
   GCAAAACCCTGTCTCTACAAAAAATACTTTCCGTACATTAGTGGTTGCCTAAGGCTAGAATTGGGGGTGATGAATGGGGAGTACAG
   GATTCATCTAATGGGTACAGGATTTCTTTATGGTTCATGAAATGGTCTAAACTTATTGTGGTAATGGTCACATAACAATATATTA
   AAAACCATTGAGTTGTATATTTTAAGTGGGTGAATTATATGGTATGTGAATTATATCTCAATAAAGTTGTTAGTAAATAAATGGGG
   CTGAAGATGTTATCCTTCATTGTGGTGTAAATGAACTTTCACAATATTTTCACCTGTGAACCCAAATAAAATGATTAAAGTTCTGA
   TGGAAAAATCTTGAATGGAGTATAAGTTTTCCGTTGTTAAAAAGCAAACAAAAAACCAACAAAAAATCCAAGTGTGCCTTGAATTG
   TACAGAGCACAATTATTATGTTTGAAATGTGTACTACTTAATTTTATATAATTTGGTTTGTGAAATTAAAGACATCAATAAAAATG
   ATTCCTGAAAGTAGTAAAAAAAAAAAAAAAAAAAAAA

22 CCTGTTCCTCTTACCCTGCCCGGCTCCAGCTGACCAGGGAAGGGGTGGGCTGAACTGAGGCGGGGGCAAGGGAGTGCCCGACATCT
   TGTCCGACTCCGCGGGTGACACGAGCCGGTTCTCTCTGGACTGGTGGCAGCGCGCGGCCCCGAACCGCGCCCCAGGCCGGCAGGCG
   GGGAAGGAGCCGGTGGGGGTAGGGGGTGCGGTGGGGGGTGGGGACCCTCCGGCTCTTGGGGGTCCCAGTCCCCGCCGGCTGCTGAG
   CGGGTGGGGTGGTGGAGGAGCTGCAGAGATGTCCGGCCAGAGCCTGACGGACCGAATCACTGCCGCCCAGCACAGTGTCACCGGCT
   CTGCCGTATCCAAGCACGATATGCAAGGCCACGACCCACGAGATCATGGGGCCCAAGAAAAAGCACCTGGACTACTTAATTCAGTGC
   ACAAATGAGATGAATGTGAACATCCCACAGTTGGCAGACAGTTTATTTGAAAGAACTACTAATAGTAGTTGGGTGGTGGTCTTCAA
   ATCTCTCATTACAACTCATCATTTGATGGTGTATGGAAATGAGCGTTTTATTCAGTATTTGGCTTCAAGAAACACGTTGTTTAACT
   TAAGCAATTTTTTGGATAAAAGTGGATTGCAAGGATATGACATGTCTACATTTATTAGGCGGTATAGTAGATATTTAAATGAGAAA
   GCAGTTTCATACAGACAAGTTGCATTTGATTTCACAAAAGTGAAGAGTGGCTGATGGAGTTATGAGAACAATGAACACAGAAAA
   ACTCCTAAAAACTGTACCAATTATTCAGAATCAGATGGATGCACTTCTTGATTTTAATGTTAATAGCAATGAACTTACAAATGGGG
   TAATAAATGCTGCCTTCATGCTCCTGTTCAAAGATGCCATTAGACTGTTTGCAGCATACAATGAAGGAATTATTAATTTGTTGGAA
   AAATATTTTGATATGAAAAAGAACCAATGCAAAGAAGGTCTTGACATCTATAAGAAGTTCCTAACTAGGATGACAAGAATCTCAGA
   GTTCCTCAAAGTTGCAGAGCAAGTTGGAATTGACAGAGGTGATATACCAGACCTTTCACAGGCCCCTAGCAGTCTTCTTGATGCTT
   TGGAACAACATTTAGCTTCCTTGGAAGGAAAGAAAATCAAAGATTCTACAGCTGCAAGCAGGGCAACTACACTTTCCAATGCAGTG
   TCTTCCCTGGCAAGCACTGGTCTATCTCTGACCAAAGTGGATGAAAGGGAAAAGCAGGCAGCATTAGAGGAAGAACAGGCACGTTT
   GAAAGCTTTAAAGGAACAGCGCCTAAAAGAACTTGCAAAGAAACCTCATACCTCTTTAACAACTGCAGCCTCTCCTGTATCCACCT
   CAGCAGGAGGGATAATGACTGCACCAGCCATTGACATATTTTCTACCCCTAGTTCTTCTAACAGCACATCAAAGCTGCCCAATGAT
   CTGCTTGATTTGCAGCAGCCCAACTTTTCACCCATCTGTACATCCTATGTCAACTGCTTCTCAGGTAGCAAGTACATGGGGAGATCC
   TTTCTCTGCTACTGTAGATGCTGTTGATGATGCCATTCCAAGCTTAAATCCTTTCCTCACAAAAAGTAGTGGTGATGTTCACCTTT
   CCATTTCTTCAGATGTATCTACTTTTACTACTAGGACACCTACTCATGAAATGTTTGTTGGATTCACTCCTTCTCCAGTTGCACAG
   CCACACCCTTCAGCTGGCCTTAATGTTGACTTTGAATCTGTGTTTGGAAATAAATCTACAAATGTTATTGTAGATTCTGGGGGCTT
   TGATGAACTAGGTGGACTTCTCAAACCAACAGTGGCCTCTCAGAACCAGAACCTTCCTGTGGCCAAACTCCCACCTAGCAAGTTAG
   TATCTGATGACTTGGATTCATCTTTAGCCAACCTTGTGGGCAATCTTGGCATCGGAAATGGAACCACTAAGAATGATGTAAATTGG
   AGTCAACCAGGTGAAAAGAAGTTAACTGGGGGATCTAACTGGCAACAAAGGTTGCACCAACAACCGCTTGCAATGCTGCAACAAT
   GGCACCCCCTGTAATGGCCTATCCTGCTACTACACCAACAGGCATGATAGGATATGGAATTCCTCCACAAATGGGAAGTGTTCCTG
   TAATGACGCAACCAACCTTAATATACAGCCAGCCTGTCATGAGACCTCCAAACCCCTTTGGCCCTGTATCAGGAGCACAGATACAG
   TTTATGTAACTTGATGGAAGAAAATGGAATTACTCCAAAAAGACAAGTGCTCAAGCAGCAAAATCCTTACTTCCAGCAAAATCCAA
   ACTGCTGTCTCTTAAATCTCTTAAACTCTCTTCTTCCATTAGAATGCTACAAGTAACTCAGTGAAGGCCCATGAAGGAAATTGGGA
   CTAGTTTATAGGAGAACGTATCAATACAGTTTATAAAGCCAAGAATTGCTATGATTTAAGACTAAGATCTGTCTTTTTGGTGACTA
   ACCCTTCAATTCTTTCAACTCTGTTAATACCCATAATCAGTAACCTATCAAGAAAAGCCCTTATTTGGAAAGTGTGAAATTTGTA
   TTTGGAAAAGCTGCCTGGAGAGAAGAACTGTGTCCTTTACTGTATTTCAACAGGACTCTTTTGGGGGATCAAAATTAAAATTCCTA
   ATTATGCATTATCTTTCTTTTCTCCAGTCCTCACAAATACAGAAACAATAACTGAATTAACTTTTCTTTTTTAAAAAAAATTAT
   ATTCAGTTTGCAGTAGACATTCCTTAAGTATTTGTATTTATTTATGATTATCAATTTTACATAACATTAATATTGTATCAGACCTC
   CTTATGAAAATGAGTATGGATGTGCACAGATGTTTGATTTTTATCACAAGAATGAATCTGATTCAGAATGTCTTTTCTCAGCTGA
   CATACAGAGCACTAAATATTTTAAGGCAAGTCCATAGGTCTGAATCTCTTAAGAATTCTCGGCTCTGTGGGATTAGGGAAGCAT
   TATAAATGCATTAATCCTTATAGTCAATTCTGTGCCTAGGATTTGCCAGGGAACAGTTCACTGACTAGGAAAAGCACTACATTTT
   AAATTCAGCATTAGTGCATTGGGAAGGATCTTTACTGCTTTGTGCTTGGCATGTCATTATTTTCCATTTGACATTAGGGCCTTTCC
   AAAATGAATGTGAAGGAATTGCTTTCACTTCAAGACTTTCCTTCTTTTGCTACTAAAACTCTAGAAGGTGTTACAAGGGGGAGGAAGG
   GGGGCAAAGTCCTTGAACATTTTCTTTGGCTCGTGCCATGTTATGATCATATACCTTTTAAATAAGGGGAATAGTATCTTTAAAG
   TTAATGTCTAGCCAAGAGTTTAGTAAACGAAGAATTAAACTGCACTGTTGATCGGTGCTTTGTGTAAATACATCTTTAACATTTGG
   GTGGAGAGGGGCCTTAAGAAGGACAGTTCATTGTAGGAAAGCAATTCTGTACATGAGTTTAAGCATTCTTGTTGCATTGTCTCTGC
   AGATTCTATTTTGTTTACAATATTAAAATGTATGTTAGCAAAATGGGTGGATTTTCAAATAAAATGCAGCTTCCACAAAAGTTTT
   GTTATGGTATTCTGGTCTGAGATGCATTTTCATTTTCCTTTCTTTTTATTATCAAATATGTCATTTTCCCTAATAAAATATA
   CCCAGGTGATTATATTTGTTGATCTAATAACATGGAAGGTTTGTTTTATATGAATTTTCAAAAAGATGTCTCTTTACACTTTTTGT
   TACCTTGTAGACTCTTATTGATAAATGCAACTACTTATTAAAATTGTTCACTTTTGTCTTTTGAAAAAAAAAAA

23 CCTCTCGGAGCTGGAAATGCAGCTATTGAGATCTTCGAATGCTGCGGAGCTGGAGGCGGAGGCAGCTGGGGAGGTCGAGCGATGT
   GACCAGGCCGCCATCGCTCGTCTCTTCCTCTCTCCTGCCGCCTCCTGTGTCGAAAATAACTTTTTTAGTCTAAAGAAAGAAAGACA
   AAAGTAGTCGTCCGCCCCTCACGCCCTCTCTTCCTCTCAGCCTTCCGCCGGTGAGGAAGCCCGGGGTGGCTGCTCCGCCGTCGGG
   GCCGCGCCGCCGAGCCCCAGCGCCCCGGGCCGCCCCGCACGCCGCCCCATGCATCCCTTCTACACCCGGGCCGCCACCATGATA
   GGCGAGATCGCCGCCGCCGTGCCTTCATCTCCAAGTTTCTCCGCACCAAGGGGCTGACGAGCGACACGTGCAGACCTTCAG
   CCAGAGCCTGCAGGAGCTGCTGGCAGAACATTATAAACATCACTGCTTCCCAGAAAAGCCATGCAAGGGATCGGGTTACCGTTGTA
   TTCGCATCAACCATAAAATGGATCCTCTGATTGGACAGGCAGCAGCAGCGGATTGGACTGAGCAGTCAGGAGCTGTTCAGGCTTCTC
   CCAAGTGAACTCACACTCTGGGTTGACCCCTATGAAGTGTCCTACAGAATTGGAGAGGATGGCTCCATCTGTGTGCTGTATGAAGC
   CTCACCAGCAGGAGGTAGCACTCAAAACAGCACCAACAATGTGATGGTAGACAGCCAATCAGCTGTAAGGAGGAACTTCTCTTGG
   GCAGAACGAGCCCTTCCAAAAACTACAATATGATGACTGTATCAGGTTAAGATATAGTCTGTGGATGGATCATCTGATGATGATCC
   ATAAATTTGATTTTGCTTTGGGTGGCTCCTCTTGGGGATGGATTATGGAATTTAAACATGTCACAGCTGTGAAGATCTGGCAC
   AAGATAGAATGGTAAAAAAAAAAAAAAATTTAAGTGACAGTGCCATAGTTTGGACAGTACCTTTCAATGATTAATTTTAATAGCC
   TGTGAGTCCAAGTAAATGATCACTTTATTTGCTAGGGAGGAAGTCCTAGGGTGGTTTCAGTTTCTCCCAGACATACCTAAATTTT
   TACATCAATCCTTTTAAAGAAAATCTGTATTTCAAAGAATCTTTCTCTGCAGTAAATCTCGCAGGGGAATTTGCACTATTACACTT
```

TABLE 1-continued

Sequences Table. First column: SEQ ID No. Second
column: corresponding mRNA sequence. For the 3 different
groups, see explanation in the text.

```
   GAAAGTTGTTATTGTTAACCTTTTCGGCAGCTTTTAATAGGAAAGTTAAACGTTTTAAACATGGTAGTACTGGAAATTTTACAAGA
   CTTTTACCTAGCACTTAAATATGTATAAATGTACATAAAGACAAACTAGTAAGCATGACCTGGGGAAATGGTCAGACCTTGTATTG
   TGTTTTTGGCCTTGAAAGTAGCAAGTGACCAGAATCTGCCATGGCAACAGGCTTTAAAAAAGACCCTTAAAAAGACACTGTCTCAA
   CTGTGGTGTTAGCACCAGCCAGCTCTCTGTACATTTGCTAGCTTGTTAGTTTTCTAAGACTGAGTAAACTTCTTATTTTTAGAAAGT
   GGAGGTCTGGTTTGTAACTTTCCTTGTACTTAATTGGGTAAAAGTCTTTTCCACAAACCACCATCTATTTTGTGAACTTTGTTAGT
   CATCTTTTATTTGGTAAATTATGAACTGGTGTAAATTTGTACAGTTCATGTATATTGATTGTGGCAAAGTTGTACAGATTTCTATA
   TTTTGGATGAGAAATTTTTCTTCTCTCTATAATAAATCGTTTCTTATCTTGGCATTTTTAACC

24 GTGAGGCTGCCGAGCGGACAGCGACTCCCGGGGAAGCCCGCGCTCCGGGAGCGGGAGCGGGAGCAGGAGCAGGAGCAGCGCCGTCC
   CAGGCCAGAGGCGAGCGCCGGGCGCCGGGAGAGCGGAGAGCCCGGGCAGCTGCCGGAGCGCGGGGGCGCGGCCCGAGGAAACCACA
   GAGCGAGCCCAGGCCTGGGGAGGGCGCCGAACATCTGAGGCGGCTTCGCGGGAGACAAAGCCGCGCGTAGAGACGCGATGCCCGCC
   GATCGCGAGCCCGCCGGCGAGGGCGCGGGGACTGCGGCGTCTGAGCGCGCCAAGCCGTGCGCCCGCGGGGACGCCGAGCCCCGGG
   GCCGGTGCGGGCGGCGGCGGGCGGGGCCCAGGTGCGCCCGGCCGCGTCGGGCCCGTGACTGCTCGGGGGGCGGCGCCCTCCCGCCG
   CAGCCGCAGTGGCTGGCGCCGCAGCCAGGAGCCATGGGCAACATCTCCTCTAACATCTCGGCCTTCCAGTCCCTGCATATCGTCAT
   GTTGGGCTTGGACTCGGCCGGCAAGACCACGGTGCTCTACCGGCTCAAGTTCAACGAGTTCGTGAACACGGTGCCCACCATCGGCT
   TCAACACCGAGAAGATCAAGCTGAGCAACGGCACGGCCAAGGGCATCAGCTGCCACTTCTGGGACGTGGGCGGCCAGGAGAAGCTG
   CGGCCGCTGTGGAAGTCCTACAGCCGCTGCACGGACGGCATCATCTACGTGGTGGACTCGGTGGACGTGGACCGGCTGGAGGAGGC
   CAAGACGGAGCTGCACAAGGTGACCAAGTTCGCCGAGAACCAGGGCACGCCGCTGCTGGTCATCGCCAACAAGCAGGACCTGCCCA
   AGTCGCTGCCGGTGGCAGAGATTGAGAAGCAGCTGGCGCTGCACGAGCTTATCCCGGCCACCACCTATCACGTCCAGCCGGCGTGC
   GCCATCATCGGCGAGGGCCTCACCGAGGGCATGGACAAGCTCTATGAGATGATCCTGAAACGCAGGAAGTCCCTCAAGCAGAAGAA
   GAAGCGGTAATGCGCCCGGAGCGACCGGGGAGCGGACGAGCGAGTGCGTCAAGAAAGAATGAATGGATGGATGGTTGGATGGATGG
   ATGGATGGATGAGCGAGAACCCGCGCCCGCGAACAAAGAGCGAACCAAAGCGATGCTTCGAATTTTTAAAACGGAATCTCTGCACC
   CAAATGCAGGACTGGTGACTTAAGGAGCTGCGAAGTCTGATTTACCGGCCTACTCTCGACCTGCCCCCCACCCCCAGCTCAGGGGA
   CCTTTTGTCTGAACGCCAGAGCTACTGACCAGGTCGGGGGGCCGCGGTGGGGAGTGGAAGAGCCGGTCCTGCTGTCCGCCCTCCCA
   GCCCCAGGTGGAAGGCTCAGTTGTCGGAAAGACAAAAGCGATTTCTTCCCACTCCTGCAGGGCCAGAAGTTCAGGCTGCCCCGCCT
   CCACTGGGGGATCGCACCTGTGAATTACCTGAGGTATGCATTTCCCAGAACCGTGGGCGTACCCACCTTGGGGGGCATGTTGGTTC
   TGGGGGGACCACCTCTCCTTGCATTCAGGGGCTGTGAAGCTGAGTAATTTTCGGTCACAGGGCAGGCCCCTGTTGAAATTTCATTT
   GTCCTGCTCTGGGCCCAAAGGTGGTGGTGGTTTGGGTCATCAGAGGACTGCCTGGGACGGTTCAGCGGGCACGGAGCGCTGTGCTG
   GCCTGGCTGGGGATGGCCGCGGAGGTGCCCTTTTCCTGGTGCTTTGTGGTGGCTGCAGAAGACCAGTTTTGTTGAGAACTGCTTTT
   CAGCCTGGAATCAGACATCTTCCAGATGGTTTGGACCCTGTCCATGTGTAGGTCATTATCACACAAAGAGACCAATAAAAATAAAA
   AAAATAAAAAAAAAAAAAGACGAACTATTGGAGGTGGTGGCCAATGATGCATTTACTGTTTGCAGGATAGTTAAAGGTGTTTAAAG
   GGTAAGGCTTTTGGTGTAAATGCTGGATGGGGTGTGTGTGTGTGGATATAGGGACCTCCCTCTGTACTGTGTACTGTGTAATCG
   GCATTAATACCTAGACTCATATGTATGGAATTTTAAATTCTCTTAGCCTACTGATTGGTTTGGATGAGCACACCAGCTGCAGGTGT
   GTGCTGAATTGCAAGATGGTATTTTTTTTTTAACCAAGGGATGTCTCTTGTAATACTAACCGCGTGATAATGGGTTTTCAGACAT
   GATGAAAAAAAAAAACTTTTACAAATGAATACTTACCTTAGAAATATTCACCTTAGGAAAAAAGACTTTGCTCTGCCCTTTTATAT
   TCCTTTATGCTGCAAGTGGTGACATGTTCAGATTTCTAATTTGGTTCATTGTGGCCTATCTGGTTTAAGTCTTTCATTAAAAATGT
   CTCGTTAGAGTATTTGATGTCATGCACCAAAAAAATAAAACCCCACCTTGTTGCAAAAGCTGACCTCGTTGCATGGAATTAAAAGA
   GAAGGAAAAACACAAGGATGAAGTCTTTCCGAATTCATTCTTGTGGGAACTGGCCTTCGGACCCAGCCAGCACTTTGGGCAAATGC
   AAACAACAATGAGTGCTTGAGATAAAAGAAAGTGTGACGTCATGGTCACTGGTACTCAGGCACTTCACAGTTTACTTGAAAGAGGC
   TTTGGAAAATAGATAAAGTGAAAGAAGAATAAATACATATTTTTAATAATGTAATTTTAAAAATCCTTTATAATCAGGACTGAGTC
   TTGGTTTGCAGAAGCTGTCACTTACCCTGAAACACAGTATCAAAAGGGAAACTTAAAACATACTGTTTGATTTTTTATTTCCTCT
   TACAATCCATGTTTTCAGGTAGAATTATGACTTTCCCCCCATTGTTACACATTTCTTTACAAAGGAGGCCTGTAGAAATTGGACAC
   GATCATGCTTGAGCATGTGAGTTAGTCAAATTATGAGTCCCTGCCTATTGTCCATTACACACCGAATGTTAATTTAAGAACCAGAG
   GCAGAAGTTCTGGCTTCCTGCTTGAAACCCAATTCTTATATGAAATTTTTTAAAAGCAGAAACCTAGCAGCCCATCTGCTTTTTCT
   CTTTTGTCGGTGTATTTGGTACCCCTCCAATGCTGGTCTTTTTGTAGAAACTCAGTAGAGAAAGTCTAGCTAAGCAGTGTTGAAAA
   GCCTGCAAGATTTCAGTTTACATATCGACAGCATATCCACTGATTTCTAAATGGGCTGCTCTAAATGCCTCGAAGATTCTGTATAGA
   ATTATTAAAAAAAAAAATCCATCTTTCTTTATTTTCTTCACATGCGACAATTTCTTAAGCACTTTGACATTTTGGTAGTTCCACACT
   ATTGAGAGAATAATATATTTATTTTGTGACATTGCAGATGCCAAATACTGTAACCTTCTCATGATAACAATACTTAGGTTCAAGAT
   CACTGTTCAAACCCTGTCATGCTTTAAAACTGATGCGAGATGATTTTGTTTTTTGCATAATCAATACTTAAGGGTGCAATCAACTG
   TTAGTAATTGTGCAGTAAAGTAAAGCCCTGTGGTGTATCAACTACTAGTTAAGAGTCTCAGTTGATTTCTGTAATGTTTGACCTAA
   TAATAGCCCGTTTCGTCTCTGACCCAACAGAGGAAGCACAGATCAAATCACCTTGGAGTGGTCACCAGGGGGACAGGGAGCCCCCC
   ACCAATGTATCAATGGGTGATTTATGATGCCTTCTGCCCTTTGGCGAGTGAATGGGTTTCCCATAGGGGAAGTTGGCCTCCCTCCG
   TGAGCTTTGGAAATGTTTTCTAATAGACACAGGGAGGCCAGTTCTGTTTCAGAGCAATTATCTTCCCAAATTCTCTGTTCTGGTGT
   TGGAACTGTGTGCCCTGGTTTCTGTTTTCCTTTCTACTGCTGTAATTCTCTGTCTCATCATCCTTCTCTTTTGTTTCCATAGCCTT
   TTATAATGCATATATGATGCTGTGAACAGAAATAAATTATTTATACAATCAAAAAAAAAAAAAAAAAAA

25 CTGCTTGTCAAAAGGCGGCAGCGGAGCCGTGTGCGCCGGGAGCGCGGAACAGCTTGTCCACCCGCCGGCCGGACCAGAAGCCTTTG
   GGTCTGAAGTGTCTGTGAGACCTCACAGAAGAGCACCCCTGGGCTCCACTTACCTGCCCCCTGCTCCTTCAGGGATGGAGGCAATG
   GCGGCCAGCACTTCCCTGCCTGACCCTGGAGACTTTGACCGGAACGCTGCCCCGGATCTGTGGGGTGTGTGGAGACCGAGCCACTGG
   CTTTCACTTCAATGCTATGACCTGTGAAGGCTGCAAAGGCTTCTTCAGGCGAAGCATGAAGCGGAAGGCACTATTCACCTGCCCCT
   TCAACGGGACTGCCGCATCACCAAGGACAACCGACGCCACTGCCAGGCCTGCCGGCTCAAACGCTGTGTGGACATCGGCATGATG
   AAGGAGTTCATTCTGACAGATGAGGAAGTGCAGAGGAAGCGGGAGATGATCCTGAAGCGGAAGGAGGAGGAGGCCTTGAAGGACAG
   TCTGCGGCCCAAGCTGTCTGAGGAGCAGCAGCGCATCATTGCCAATCTGCTGGACGCCCACCATAAGACCTACGACCCCACCTACT
   CCGACTTCTGCCAGTTCCGGCCTCCAGTTCGTGTGAATGATGGTGGAGGGAGCCATCTTCCAGGCCCAACTCCAGACACACTCCC
   AGCTTCTCTGGGGACTCCTCCTCCTCCTGCTCAGATCACTGTATCACCTCTTCAGACATGATGGACTCGTCCAGCTTCTCCAATCT
   GGATCTGAGTGAAGAAGATTCAGATGACCCTTCTGTGACCCTAGAGCTGTCCCAGCTCTCCATGCTGCCCCACCTGGCTGACCTGG
   TCAGTTACAGCATCCAAAAGGTCATTGGCTTTGCTAAGATGATCCCAGGATTCAGAGACCTCACCTCTGAAGACCAGATCGTACTG
   CTGAAGTCAAGTGCCATTGAGGTCATCATGTTGCGCTCCAATGAGTCCTTCACCATGGACGACATGTCCTGGACCTGTGGCAACCA
   AGACTACAAGTACCGCGTCAGTGACGTGACCAAAGCCGGACACAGCCTGGAGCTGATTGAGCCCCTCATCAAGTTCCAGGTGGGAC
   TGAAGAAGCTGAACTTGCATGAGGAGGAGCATGTCCTGCTCATGGCCATCTGCATCGTCTCCCCAGATCGTCCTGGGGGTGCAGGAC
   GCCGGCTGATTGAGGCCATCCAGGACCGCCTGTCCAACACACTGCAGACGTACATCCGCTGCCGCCACCCCCCCCGGGCAGCCA
   CCTGCTCTATGCCAAGATGATCCAGAAGCTAGCCGACCTGCGCAGCCTCAATGAGGAGCACTCCAAGCAGTACCGCTGCCTCTCCT
   TCCAGCCTGAGTGCAGCATGAAGCTAACGCCCCTTGTGCTGAAGTGTTTGGCAATGAGATCTCCTGACTAGGACAGCCTGTGGCG
   GTGCCTGGGTGGGGCTGCTCCTCCAGGGCCACGTGCCAGGCCCGGGGCTGGCGGCTACTCAGCAGCCCTCCTCACCCCGTCTGGGG
   TTCAGCCCCCTCCTCTGCCACCTCTCCCTATCCACCCAGCCCATTCTCTCTCCTGTCCAACCTAACCCCTTTCCTGCGGGCTTTTCCC
   CGGTCCCTTGAGACCTCAGCCATGAGGAGTTGCTGTTTGTTTGACAAAGAAACCCAAGTGGGGGCAGAGGGCAGAGGCTGGAGGCA
```

TABLE 1-continued

Sequences Table. First column: SEQ ID No. Second column: corresponding mRNA sequence. For the 3 different groups, see explanation in the text.

```
   GGGCCTTGCCCAGAGATGCCTCCACCGCTGCCTAAGTGGCTGCTGACTGATGTTGAGGGAACAGACAGGAGAAATGCATCCATTCC
   TCAGGGACAGAGACACCTGCACCTCCCCCACTGCAGGCCCCGCTTGTCCAGCGCCTAGTGGGGTCTCCCTCTCCTGCCTACTCAC
   GATAAATAATCGGCCCACAGCTCCCACCCCACCCCCTTCAGTGCCCACCAACATCCCATTGCCCTGGTTATATTCTCACGGGCAGT
   AGCTGTGGTGAGGTGGGTTTTCTTCCCATCACTGGAGCACCAGGCACGAACCCACCTGCTGAGAGACCCAAGGAGGAAAAACAGAC
   AAAAACAGCCTCACAGAAGAATATGACAGCTGTCCCTGTCACCAAGCTCACAGTTCCTCGCCCTGGGTCTAAGGGGTTGGTTGAGG
   TGGAAGCCCTCCTTCCACGGATCCATGTAGCAGGACTGAATTGTCCCCAGTTTGCAGAAAAGCACCTGCCGACCTCGTCCTCCCCC
   TGCCAGTGCCTTACCTCCTGCCCAGGAGAGCCAGCCCTCCCTGTCCTCCTCGGATCACCGAGAGTAGCCGAGAGCCTGCTCCCCCA
   CCCCCTCCCCAGGGGAGAGGGTCTGGAGAAGCAGTGAGGTGAGCCGCATCTTCTCCATCTGGCAGGGTGGGATGGAGGAGAAGAATTTTCA
   GACCCCAGCGGCTGAGTCATGATCTCCCTGCCGCCTCAATGTGGTTGCAAGGCCGCTGTTCACCCACAGGGCTAAGAGCTAGCGCT
   GCCGCACCCCAGAGTGTGGGAAGGGAGAGCGGGGCAGTCTCGGGTGGCTAGTCAGAGAGAGTGTTTGGGGGTTCCGTGATGTAGGG
   TAAGGTGCCTTCTTATTCTCACTCCACCACCCAAAAGTCAAAAGGTGCCTGTGAGGCAGGGGCGGAGTGATACAACTTCAAGTGCA
   TGCTCTCTGCAGCCAGCCCAGCCCAGCTGGTGGGAAGCGTCTGTCCGTTTACTCCAAGGTGGGGTCTTTGTGAGAGTGAGCTGTAG
   GTGTGCGGGACCGGTACAGAAGGCGTTCTTCGAGGTGGATCACAGAGGCTTCTTCAGATCAGTGCTTGAGTTTGGGGAATGCGGC
   CGCATTCCCTGAGTCACCAGGAATGTTAAAGTCAGTGGGAACGTGACTGCCCCAACTCCTGGAAGCTGTGTCCTTGCACCTGCATC
   CGTAGTTCCTGAAACCCAGAGAGGAATCAGACTTCACACTGCAAGAGCCTTGGTGTCCACCTGGCCCCATGTCTCTCAGAATTC
   TTCAGGTGGAAAAACATCTGAAAGCCACGTTCCTTACTGCAGAATAGCATATATATCGCTTAATCTTAAATTTATTAGATATGAGT
   TGTTTTCAGACTCAGACTCCATTTGTATTATAGTCTAATATACAGGGTAGCAGGTACCACTGATTTGGAGATATTTATGGGGGGAG
   AACTTACATTGTGAAACTTCTGTACATTAATTATTATTGCTGTTGTTATTTTACAAGGGTCTAGGGAGAGACCCTTGTTTGATTTT
   AGCTGCAGAACGTATTGGTCCAGCTTGCTCTTCAGTGGGAGAAAACACTTGTAAGTTGCTAAACGAGTCAATCCCCTCATTCAGGA
   AAACTGACAGAGGAGGGCGTGACTCACCCAAGCATATATAACTAGCTAGAAGTGGGCCAGGACAGGCCCGGCGCGGTGGCTCACGC
   CTGTAATCCCAGCAGTTTGGGAGGTCGAGGTAGGTGGATCACTTGAGGTCGGGAGTTTGAGACCAACCTGACCAACATGGAGAAAC
   CCTGTCTCTATTAAAAATACAAAAAAAAAAAAAAAAAAAAATAGCCGGGCATGGTGGCGCAAGCCTGTAATCCCAGCTACTCAGGAG
   GCTGAGGCAGAAGAATTGAACCCAGGAGGTGGAGGTTGCAGTGAGCTGAGATCGTGCCGTTACTCTCCAACCTGGACAACAAGAGC
   GAAACTCCGTCTTAGAAGTGGACCAGGACAGGACCAGATTTTGGAGTCATGGTCCGGTGTCCTTTTCACTACACCATGTTTGAGCT
   CAGACCCCCACTCTCATTCCCCAGGTGGCTGACCCAGTCCCTGGGGAGAGCCCTGGATTTCAGAAAGAGCAAGTCTGGATCTGGGA
   CCCTTTCCTTCCTTCCCTGGCTTGTAACTCCACCAACCCATCAGAAGGAGAAGGAAGGAGACTCACCTCTGCCTCAATGTGAATCA
   GACCCTACCCCACCACGATGTGGCCCTGGCCTGCTGGGCTCTCCACCTCAGCCTTGGATAATGCTGTTGCCTCATCTATAACATGC
   ATTTGTCTTTGTAATGTCACCACCTTCCCAGCTCTCCCTCTGGCCCTGCCTTCTTCGGGGAACTCCTGGAAATATCAGTTACTCAG
   CCCTGGGCCCCACCACCTAGGCCACTCCTCCAAAGGAAGTCTAGGAGCTGGGAGGGAGAAAGAAGGGGGAAAATGAGTTTTTATG
   GGGCTGAACGGGGAGAAAAGGTCATCATCGATTCTACTTTAGAATGAGAGTGTGAAATAGACATTTGTAAATGTAAAACTTTTAAG
   GTATATCATTATAACTGAAGGAGAAGGTGCCCAAAATGCAAGATTTTCCACAAGATTCCCAGAGACAGGAAAATCCTCTGGCTGG
   CTAACTGGAAGCATGTAGGAGAATCCAAGCGAGGTCAACAGAGAAGGCAGGAATGTGTGGCAGATTTAGTGAAAGCTAGAGATATG
   GCAGCGAAAGGATGTAAACAGTGCCTGCTGAATGATTTCCAAAGAGAAAAAAAGTTTGCCAGAAGTTTGTCAAGTCAACCAATGTA
   GAAAGCTTTGCTTATGGTAATAAAAATGGCTCATACTTATATAGCACTTACTTTGTTGCAAGTACTGCTGTAAATAAATGCTTTAT
   GCAAACCAAAAAAAAAAAAAAAAAAA

26 GCAACTGGGGGCGCCCCGGACGACCATGAGAGATAAGGACTGAGGGCCAGGAAGGGGAAGCGAGCCCGCCGAGAGGTGGCGGGGAC
   TGCTCACGCCAAGGGCCACAGCGGCCGCTCCGGCCTCGCTCCGCCGCTCCACGCTCGCGGGATCCGCGGGGATCCAGCCCGGCCG
   GGCGGGGATGCCGGGGCTGGGGCGGAGGGCGCAGTGGCTGTGCTGGTGGGGGCTGCTGGTGCTGCGGGCCCCCGCCGC
   TGCGGCCGCCCTTGCCCGCTGCCGCGGCCGCCGCCGCGGGGGGCAGCTGCTGGGGGACGGCGGGAGCCCCGGCCGCACGGAGCAG
   CCGCCGCCGTCGCCGCAGTCCTCCTCGGGCTTCCTGTACCGGCGGCTCAAGACGCAGGAGAAGCGGGAGATGCAGAAGGAGATCTT
   GTCGGTGCTGGGGCTCCCGCCACCGGCCCCGGCCCCTGCACGGCCTCCAACAGCCGCAGCCCCCGGCGCTCCGGCAGCAGGAGGAGC
   AGCAGCAGCAGCAGCAGCTGCCTCGCCGAGAGCCCCCTCCCGGGCGACTGAAGTCCGCGCCCCTCTTCATGCTGGATCTGTACAAC
   GCCCTGTCCGCCGACAACGACGAGGACGGGGCGTCGGAGGGGGAGAGGCAGCAGTCCTGGCCCCACGAAGCAGCAGCTCGTCCCA
   GCGTCGGCAGCCGCCCCCGGGCGCCGCGCACCCGCTCAACCGCAAGAGCCTTCTGGCCCCCGGATCTGGCAGCGGCGGCGCGTCCC
   CACTGACCAGCGCGCAGGACAGCGCGCCTTCCTCAACGACGACATGGTCATGAGCTTTGTGAACCTGGTGGAGTACGACAAGGAG
   TTCTCCCCTCGTCAGCGACACCACAAAGAGTTCAAGTTCAACTTATCCCAGATTCCTGAGGGTGAGGTGGTGACGGCTGCAGAATT
   CCGCATCTACAAGGACTGTGTTATGGGGAGTTTTAAAAACCAAACTTTTCTTATCAGCATTTATCAAGTCTTACAGGAGCATCAGC
   ACAGAGACTCTGACCTGTTTTGTTGGACACCCGTGTAGTATGGGCCTCAGAAGAAGGCTGGCTGGAATTTGACATCACGGCCACT
   AGCAATCTGTGGGTTGTGACTCCACAGCATAACATGGGGCTTCAGCTGAGCGTGGTGACAAGGGATGGAGTCCACGTCCACCCCCG
   AGCCGCAGGCCTGGTGGGCAGAGACAGGCCCTTACGATAAGCAGCCCTTCATGGTGGCTTTCTTCAAAGTGAGTGAGGTCCACGTGC
   GCACCACCAGGTCAGCCTCCAGCCGGCGCCGACAACAGAGTCGTAATCGCTCTACCCAGTCCCAGGACGTGGCGCGGGTCTCCAGT
   GCTTCAGATTACAACAGCAGTGAATTGAAAACAGCCTGCAGGAAGCATGAGCTGTATGTGAGTTTCCAAGACCTGGGATGGCAGGA
   CTGGATCATTGCACCCAAGGGCTATGCTGCCAATTACTGTGATGGAGAATGCTCCTTCCCACTCAACGCACACATGAATGCAACCA
   ACCACGCGATTGTGCAGACCTTGGTTCACCTTATGAACCCCGAGTATGTCCCCAAACCGTGCTGTGCGCCAACTAAGCTAAATGCC
   ATCTCGGTTCTTTACTTTGATGACAACTCCAATGTCATTCTGAAAAAATACAGGAATATGGTTGTAAGAGCTTGTGGATGCCACTA
   ACTCGAAACCAGATGCTGGGGACACACATTCGCCTTGGATTCCTAGATTACATCTGCCTTAAAAAAACACGGAAGCACAGTTGGA
   GGTGGGACGATGGACTTTGAAACTATCTCATGCCAGTGCCTTATTACCCAGGAAGATTTTAAAGGACCTCATTAATAATTTGCTC
   ACTTGGTAAATGACGTGAGTAGTTGTTGGTCTGTAGCAAGCTGAGTTTGGATGTCTGTAAATAAGGTCTGGTAACTGCAGAAACA
   TAACCGTGAAGCTCTTCCTACCCTCCTCCCCCAAAAACCCACCAAAATTAGTTTTAGCTGTAGATCAAGCTATTTGGGGTGTTTGT
   TAGTAAATAGGGAAATAATCTCAAAGGAGTTAAATGTATTCTTGGCTAAAGGATCAGCTGGTTCAGTACTGTCTATCAAAGGTAG
   ATTTTACAGAGAACAGAAATCGGGGAAGTGGGGGGAACGCCTCTGTTCAGTTCATTCCCAGAAGTCCACAGGACGCACAGCCCAGG
   CCACAGCCAGGGCTCCACGGGGCGCCCTTGTCTCAGTCATTGCTGTTGTGTATGTTCGTGCTGGAGTTTTGTTGGTGTGAAAATACAC
   TTATTTCAGCCAAAACATACCATTTCTACACCTCAATCCTCCATTTGCTGTACTCTTTGCTAGTACCAAAAGTAGACTGATTACAC
   TGAGGTGAGGCTACAAGGGGTGTGTAACCGTGTAACACGTGAAGGCAGTGCTCACCTCTTCTTTACCAGACGGTTCTTTGACCAG
   CACATTAACTTCTGGACTGCCGGCTCTAGTACCTTTTCAGTAAAGTGGTTCTCTGCCTTTTTACTATACAGCATACCACGCCACAG
   GGTTAGAACCAACGAAGAAATAAAATGAGGGTGCCCAGCTTATAGAATGGTTGGGGGATGAGCATGCTGTTTATGAACGGA
   AATCATGATTTCCCTGTAGAAAGTGAGGCTCAGATTAAATTTTAGAATATTTTCTAAATGTCTTTTTCACAATCATGTGACTGGGA
   AGGCAATTTCATACTAAACTGATTAAATAATACATTTATAATCTACAACTGTTTGCACTTACAGCTTTTTTGTAAATATAAACTA
   TAATTTATTGTCTATTTTATATCTGTTTTGCTGTGGCGTTGGGGGGGGGCCGGGCTTTTGGGGGGGGGGTTTGTTTGGGGGGTG
   TCGTGGTGTGGGCGGGCGG

27 ATGGCCCTGTCCACTGAGCATCCTCCCGCCACACAGAAACCCGCCCAGCCGGGGCCACCGACCCCACCCCCTGCCTGGAAACTTAA
   GGAGGCCGGAGCTGTGGGGAGCTCAGAGCTGAGATCCTACAGGAGTCCAGGGCTGGAGAGAAAACCTCTGCGAGGAAAGGGAAGGA
   GCAAGCCGTGAATTTAAGGGACGCTGTGAAGCAATCATGGATGCAATGAAGAGAGGGCTCTGCTGTGTGCTGCTGCTGTGTGGAGC
   AGTCTTCGTTTCGCCCAGCCAGGAAATCCATGCCCGATTCAGAAGAGGAGCCAGATCTTACCAAGTGATCTGCAGAGATGAAAAA
```

TABLE 1-continued

Sequences Table. First column: SEQ ID No. Second
column: corresponding mRNA sequence. For the 3 different
groups, see explanation in the text.

```
   CGCAGATGATATACCAGCAACATCAGTCATGGCTGCGCCCTGTGCTCAGAAGCAACCGGGTGGAATATTGCTGGTGCAACAGTGGC
   AGGGCACAGTGCCACTCAGTGCCTGTCAAAAGTTGCAGCGAGCCAAGGTGTTTCAACGGGGGCACCTGCCAGCAGGCCCTGTACTT
   CTCAGATTTCGTGTGCCAGTGCCCCGAAGGATTTGCTGGGAAGTGCTGTGAAATAGATACCAGGGCCACGTGCTACGAGGACCAGG
   GCATCAGCTACAGGGGCACGTGGAGCACAGCGGAGAGTGGCGCCAGGTGCACCAACTGGAACAGCAGCGCGTTGGCCCAGAAGCCC
   TACAGCGGGCGGAGGCCAGACGCCATCAGGCTGGGCCTGGGGAACCACAACTACTGCAGAAACCCAGATCGAGACTCAAAGCCCTG
   GTGCTACGTCTTTAAGGCGGGGAAGTACAGCTCAGAGTTCTGCAGCACCCCTGCCTGCTCTGAGGGAAACAGTGACTGCTACTTTG
   GGAATGGGTCAGCCTACCGTGGCACGCACAGCCTCACCGAGTCGGGTGCCTCCTGCCTCCCGTGGAATTCCATGATCCTGATAGGC
   AAGGTTTACACAGCACAGAACCCCAGTGCCCAGGCACTGGGCCTGGGCAAACATAATTACTGCCGGAATCCTGATGGGGATGCCAA
   GCCCTGGTGCCACGTGCTGAAGAACCGCAGGCTGACGTGGGAGTACTGTGATGTGCCCTCCTGCTCCACCTGCGGCCTGAGACAGT
   ACAGCCAGCCTCAGTTTCGCATCAAAGGAGGGCTCTTCGCCGACATCGCCTCCCACCCCTGGCAGGCTGCCATCTTTGCCAAGCAC
   AGGAGGTCGCCCGGAGAGCGGTTCCTGTGCGGGGGCATACTCATCAGCTCCTGCTGGATTCTCTCTGCCGCCCACTGCTTCCAGGA
   GAGGTTTCCGCCCCACCACCTGACGGTGATCTTGGGCAGAACATACCGGGTGGTCCCTGGCGAGGAGGAGCAGAAATTTGAAGTCG
   AAAAATACATTGTCCATAAGGAATTCGATGATGACACTTACGACAATGACATTGCGTGCTGCAGCTGAAATCGGATTCGTCCCGC
   TGTGCCCAGGAGAGCAGCGTGGTCCGCACTGTGTGCCTTCCCCCGGCGGACCTGCAGCTGCCGGACTGGACGGAGTGTGAGCTCTC
   CGGCTACGGCAAGCATGAGGCCTTGTCTCCTTTCTATTCGGAGCGGCTGAAGGAGGCTCATGTCAGACTGTACCCATCCAGCCGCT
   GCACATCACAACATTTACTTAACAGAACAGTCACCGACAACATGCTGTGTGCTGGAGACACTCGGAGCGGCGGGCCCCAGGCAAAC
   TTGCACGACGCCTGCCAGGGCGATTCGGGAGGCCCCCTGGTGTGTCTGAACGATGGCCGCATGACTTTGGTGGGCATCATCAGCTG
   GGGCCTGGGCTGTGGACAGAAGGATGTCCCGGGTGTGTACACCAAGGTTACCAACTACCTAGACTGGATTCGTGACAACATGCGAC
   CGTGACCAGGAACACCCGACTCCTCAAAAGCAAATGAGATCCCGCCTCTTCTTCTTCAGAAGACACTGCAAAGGCGCAGTGCTTCT
   CTACAGACTTCTCCAGACCCACCACACCGCAGAAGCGGGACGAGACCCTACAGGAGAGGGAAGAGTGCATTTTCCCAGATACTTCC
   CATTTTGGAAGTTTTCAGGACTTGGTCTGATTTCAGGATACTGTCTCAGAAGGGAAGACATGAATGCACACTAGCCTCTCCAGGAA
   TGCCTCCTCCCTGGGCAGAAAGTGGCCATGCCACCCTGTTTTCAGCTAAAGCCCAACCTCCTGACCTGTCACCGTGAGCAGCTTTG
   GAAACAGGACCACAAAAATGAAAGCATGTCTCAATAGTAAAAGATAACAAGATCTTTCAGGAAAGACGGATTGCATTAGAAATAGA
   CAGTATATTTATAGTCACAAGAGCCCAGCAGGGCCTCAAAGTTGGGGCAGGCTGGCTGGCCCGTCATGTTCCTCAAAAGCACCCTT
   GACGTCAAGTCTCCTTCCCCTTTCCCCACTCCCTGGCTCTCAGAAGGTATTCCTTTTGTGTACAGTGTGTAAAGTGTAAATCCTTT
   TTCTTTATAAACTTTAGAGTAGCATGAGAGAATTGTATCATTTGAACAACTAGGCTTCAGCATATTTATAGCAATCCATGTTAGTT
   TTTACTTTCTGTTGCCACAACCCTGTTTTATACTGTACTTAATAAATTCAGATATATTTTTCACAGTTTTTCC

28 GCCGGCCGAACCCAGACCCGAGGTTTTAGAAGCAGAGTCAGGCGAAGCTGGGCCAGAACCGCGACCTCCGCAACCTTGAGCGGCAT
   CCGTGGAGTGCGCCTGCGCAGCTACGACCGCAGCAGGAAAGCGCCGCCGGCCAGGCCCAGCTGTGGCCGGACAGGGACTGGAAGAG
   AGGACGCGGTCGAGTAGGTGTGCACCAGCCCTGGCAACGAGAGCGTCTACCCCGAACTCTGCTGGCCTTGAGGTGGGGAAGCCGGG
   GAGGGCAGTTGAGGACCCCGCGGAGGCGCGTGACTGGTTGAGCGGGCAGGCCAGCCTCCGAGCCGGGTGGACACAGGTTTTAAAAC
   ATGAATCCTACACTCATCCTTGCTGCCTTTTGCCTGGGAATTGCCTCAGCTACTCTAACATTTGATCACAGTTTAGAGGCACAGTG
   GACCAAGTGGAAGGCGATGCACAACAGATTATACGGCATGAATGAAGGAAGGATGGAGGAGAGCAGTGTGGGAGAAGAACATGAAGA
   TGATTGAACTGCACAATCAGGAATACAGGGAGGGAAACACAGCTTCACAATGGCCATGAACGCCTTTGGAGACATGACCAGTGAA
   GAATTCAGGCAGGTGATGAATGGCTTTCAAAACCGTAAGCCCAGGAAGGGGAAAGTGTTCCAGGAACCTCTGTTTTATGAGGCCCC
   CAGATCTGTGGATTGGAGAGAGAAAGGCTACGTGACTCCTGTGAAGAATCAGGGTCAGTGTGGTTCTTGTTGGGCTTTTAGTGCTA
   CTGGTGCTCTTGAAGGACAGATGTTCCGGAAAACTGGGAGGCTTATCTCACTGAGTGAGCAGAATCTGGTAGACTGCTCTGGGCCT
   CAAGGCAATGAAGGCTGCAATGGTGGCCTAATGGATTATGCTTTCCAGTATGTTCAGGATAATGGAGGCCTGGACTCTGAGGAATC
   CTATCCATATGAGGCAACAGAAGAATCCTGTAAGTACAATCCCAAGTATTCGTTGCTAATGACACCGGCTTTGTGGACATCCCTA
   AGCAGGAGAAGGCCCTGATGAAGGCAGTTGCAACTGTGGGGCCCATTTCTGTTGCTATTGATGCAGGTCATGAGTCCTTCCTGTTC
   TATAAAGAAGGCATTTATTTTGAGCCAGACTGTAGCAGTGAAGACATGGATCATGGTGGCACGTGGTTGGCTACGGATTTGAAAG
   CACAGAATCAGATAACAATAAATATTGGCTGGTGAAGAACAGCTGGGGTGAAGAATGGGGCATGGGTGGCTACGTAAAGATGGCCA
   AAGACCGGAGAAACCATTGTGGAATTGCCTCAGCAGCCAGCTACCCCACTGTGTGAGCTGCTGGACGGTGATGAGGAAGGACTTGA
   CTGGGGATGGCGCATGCATGGGAGGAATTCATCTTCAGTCTACCAGCCCCCGCTGTGTCGGATACACACTGAATCATTGAAGATC
   CGAGTGTGATTTGAATTCTGTGATATTTTCACACTGGTAAATGTTACCTCTATTTTAATTACTGCTATAAATAGGTTTATATTATT
   GATTCACTTACTGACTTTGCATTTTCGTTTTTAAAAGGATGTATAAATTTTTACCTGTTTAAATAAAATTTAATTTCAAATGTA

29 AGAGGACGCCCGGTGAAGGGGCTCCAGCCTGGCAGTTTCTGCGTGTTAGCATTTCTAGAATAGAGTGGGTGGGAACTGACCCAAGT
   AAAGTCCCAGAGACTCGAACACTGACGCACAGGAAAGCCTCAAGTGGGAGGAGAAATGCAAATCCCCTACTGATGATGGCGTCAGC
   GGCTTTCTCCTAGGGACTGTGAGGGGCGCTTCTGACTTTGGACTTGAGCACTGCCTGGGACCTGTGCTGAGAGAGCGCTAGCATGT
   CTCAGTGGAATCAAGTCCAACAGTTAGAAATCAAGTTTTTGGAGCAGGTGGATCAATTCTATGATGACAACTTTCCCATGGAAATT
   CGGCATCTGTTGGCCCAATGGATTGAAAATCAAGACTGGGAGGCAGCTTCTAACAATGAAACCATGGCAACGATTCTTCTTCAAAA
   CTTGTTAATACAACTGGATGAACAGTTAGGTCGTGTTTCCAAAGAGAAAAACCTACTCTTGATACACAATCTAAAAAGAATTAGGA
   AGGTCCTTCAGGGAAAATTCATGGAAATCCAATGCATGTAGCTGTGGTTATTTCAAACTGTTTAAGGGAAGAGAGGAGAATATTG
   GCTGCAGCCAACATGCCTGTCCAGGGGCCTCTAGAGAAATCCTTACAAAGTTCTTCAGTTTCAGAAAGACAGAGGAATGTGGAGCA
   CAAAGTGGCTGCCATTAAAAACAGTGTGCAGATGACAGAACAAGATACCAAATACTTAGAAGATCTGCAAGACGAATTTGACTACA
   GGTATAAAACAATTCAGACAATGGATCAGATGACAAGAATAGTGCCATGGTGAATCAGGAAGTTTTGACACTGCAGGAAATGCTT
   AACAGCCTCGATTTCAAGAGAAAGAGGCTCTCAGTAAAATGACCTCTGGTAAAATGATCATCCATGAGACAGACCTGTTAATGAACACCATGCT
   CATAGAAGAGCTGCAAGACTGGAAGCGGCGGCAGCAAATCGCCTGCATCGGGGTCCACTCCACATGGGCTCGACCAGCTTCAGA
   ACTGCTTTACACTATTGGCAGAAAGTCTTTTCCAACTGAGAAGCAATTGGAGAAATAGAGGAGCAATCTACCAAAATGACATAT
   GAAGGTGATCCCATTCCAATGCAAAGAACTCACATGCTAGAAAGAGTCACCTTCTTGATCTACAACCTTTTCAAGAACTCATTTGT
   GGTTGAGCGACAGCCATGTATGCCAACCCACCTCAGAGGCCGTTGGTACTTAAAACCCTAATTCAGTTCACTGTAAAACTAAGGC
   TACTAATAAAATTGCCAGAACTAAACTATCAGGTAAAGGTTAAGGCATCAATTGACAAGAATGTTTCAACTCTAAGCAACCGAAGA
   TTTGTACTTTGTGGAACTAATGTCAAAGCCATGTCTATTGAAGAATCTTCCAATGGGAGTCTCTCAGTAGAATTTGACATTTGCA
   ACCAAAGGAAATGAAGTCCAGTGCTGGAGGTAAAGGAAATGAGGGCTGTCACATGGTGACTGAAGAACTTCATTCCATAACGTTTG
   AAACACAGATCTGCCTCTATGGCCTGACCATAGATTTGGAGACCAGCTCATTGCCTGTGGTGATGATTTCCAATGTCAGTCAGTTA
   CCTAATGCTTGGGCATCCATCATTTGGTACAACGTGTCAACCAACGATTCCCAGAACTTGGTTTTCTTTAATAATCCTCCACCTGC
   CACATTGAGTCAACTACTGGAGGTGATGAGCTGGCAGTTTTCATCGTACGTTGGTCGTGGTCTTAACTCAGATCAACTCCATATGC
   TGGCAGAGAAGCTTACAGTCCAATCTAGCTACAGTGATGGTCACCTCACCTGGGCCAAGTTCTGCAAGGAACATTTACCTGGTAAA
   TCATTTACCTTTTGGACATGCCTTTGGAAGCAATATTGGATCTAATTAAGAACACATTCTTCCCCCTTTGGATTGATGGGTATGTCAT
   GGGCTTTGTTAGCAAAGAGAAGGAACGGCTGTTGCTAAAGGATAAAATGCCTGGCACCTTTTATTAAGATTCAGTGAAAGCCATC
   TCGGAGGAATAACTTTCACCTGGGTGGACATTCTGAAAGTGGGGAAGTGAGATTCCACTCTGTAGAACCCTACAATAAAGGCCGG
   TTGTCTGCTCTGCCATTCGCTGACATCCTGCGAGACTACAAAGTTATTATGGCTGAAACATTCCTGAAAACCCTCTGAAGTACCT
   ATATCCTGACATTCCCAAAGACAAAGCCTTCGGTAAACACTACAGCTCTCAGCCTTGCGAAGTTTCAAGACCAACAGAAGGGGTG
   ACAAAGGTTATGTTCCTTCTGTTTTTATCCCCATCTCAACAATCCGAAGTGATTCAACAGAGCCACATTCTCCATCAGACCTTCTT
```

TABLE 1-continued

Sequences Table. First column: SEQ ID No. Second column: corresponding mRNA sequence. For the 3 different groups, see explanation in the text.

```
   CCCATGTCTCCAAGTGTGTATGCGGTGTTGAGAGAAAACCTGAGTCCCACAACAATTGAAACTGCAATGAAGTCTCCTTATTCTGC
   TGAATGACAGGATAAACTCTGACGCACCAAGAAAGGAAGCAAATGAAAAAGTTTAAAGACTGTTCTTTGCCCAATAACCACATTTT
   ATTTCTTCAGCTTTGTAAATACCAGGTTCTAGGAAATGTTTGACATCTGAAGCTCTCTTCACACTCCCGTGGCACTCCTCAATTGG
   GAGTGTTGTGACTGAAATGCTTGAAACCAAAGCTTCAGATAAACTTGCAAGATAAGACAACTTTAAGAAACCAGTGTTAATAACAA
   TATTAACAG

30 GGAAGGCTTGCACAGGGTGAAAGCTTTGCTTCTCTGCTGCTGTAACAGGGACTAGCACAGACACACGGATGAGTGGGGTCATTTCC
   AGATATTAGGTCACAGCAGAAGCAGCCAAAATGGATCCCCAGTGCACTATGGGACTGAGTAACATTCTCTTTGTGATGGCCTTCCT
   GCTCTCTGGTGCTGCTCCTCTGAAGATTCAAGCTTATTTCAATGAGACTGCAGACCTGCCATGCCAATTTGCAAACTCTCAAAACC
   AAAGCCTGAGTGAGCTAGTAGTATTTTGGCAGGACCAGGAAAACTTGGTTCTGAATGAGGTATACTTAGGCAAAGAGAAATTTGAC
   AGTGTTCATTCCAAGTATATGGGCCGCACAAGTTTTGATTCGGACAGTTGGACCCTGAGACTTCACAATCTTCAGATCAAGGACAA
   GGGCTTGTATCAATGTATCATCCATCACAAAAAGCCCACAGGAATGATTCGCATCCACCAGATGAATTCTGAACTGTCAGTGCTTG
   CTAACTTCAGTCAACCTGAAATAGTACCAATTTCTAATATAACAGAAAATGTGTACATAAATTTGACCTGCTCATCTATACACGGT
   TACCCAGAACCTAAGAAGATGAGTGTTTTGCTAAGAACCAAGAATTCAACTATCGAGTATGATGGTGTTATGCAGAAATCTCAAGA
   TAATGTCACAGAACTGTACGACGTTTCCATCAGCTTGTCTGTTTCATTCCCTGATGTTACGAGCAATATGACCATCTTCTGTATTC
   TGGAAACTGACAAGACGCGGCTTTTATCTTCACCTTTCTCTATAGAGCTTGAGGACCCTCAGCCTCCCCCAGACCACATTCCTTGG
   ATTACAGCTGTACTTCCAACAGTTATTATATGTGTGATGGTTTTCTGTCTAATTCTATGAGAAATGGAAGAAGAAGAAGCGGCCTCG
   CAACTCTTATAAATGTGGAACCAACACAATGGAGAGGGAAGAGAGTGAACAGACCAAGAAAAGAGAAAAAATCCATATACCTGAAA
   GATCTGATGAAGCCCAGCGTGTTTTTAAAAGTTCGAAGACATCTTCATGCGACAAAAGTGATACATGTTTTTAATTAAAGAGTAAA
   GCCCATACAAGTATTCATTTTTTCTACCCTTTCCTTTGTAAGTTCCTGGGCAACTTTTTGATTTCTTCCAGAAGGCAAAAAGACA
   TTACCATGAGTAATAAGGGGGCTCCAGGACTCCCTCTAAGTGGAATAGCCTCCCTGTAACTCCAGCTCTGCTCCGTATGCCAAGAG
   GAGACTTTAATTCTCTTACTGCTTCTTTTCACTTCAGAGCACACTTATGGGCCAAGCCCAGCTTAATGGCTCATGACCTGGAAATA
   AAATTTAGGACCAATACCTCCTCAGATCAGATTCTTCTCTTAATTTCATAGATTGTGTTTTTTTTTAAATAGACCTCTCAATTT
   CTGGAAAACTGCCTTTTATCTGCCCAGAATTCTAAGCTGGTGCCCCACTGAATTTTGTGTGTACCTGTGACTAAACAACTACCTCC
   TCAGTCTGGGTGGGACTTATGTATTTATGACCTTATAGTGTTAAATATCTTGAAACATAGAGATCTATGTACTGTAATAGTGTGATT
   ACTATGCTCTAGAGAAAAGTCTACCCCTGCTAAGGAGTTCTCATCCCTCTGTCAGGGTCAGTAAGGAAAACGGTGGCCTAGGGTAC
   AGGCAACAATGAGCAGACCAACCTAAATTTGGGGAAATTAGGAGAGGCAGAGATAGAACCTGGAGCCACTTCTATCGGGCTGTTG
   CTAATATTGAGGAGGCTTGCCCCACCCAACAAGCCATAGTGGAGAGAACTGAATAAACAGGAAAATGCCAGAGCTTGTGAACCCTG
   TTTCTCTTGAAGAACTGACTAGTGAGATGGCCTGGGGAAGCGTGGGAAGATCAGAAGGATCACAATACTCAAAAGAGAGAGA
   GAGAAAAAAGAGAGATCTTGATCCACAGAAATACATGAAATGTCTGGTCTGTCCACCCCATCAACAAGTCTTGAAACAAGCAACAG
   ATGGATAGTCTGTCCAAATGGACATAAGACAGACAGCAGTTTCCCTGGTGGTCAGGGAGGGGTTTTGGTGATACCCAAGTTATTGG
   GATGTCATCTTCCTGGAAGCAGAGCTGGGGAGGGAGAGCCATCACCTTGATAATGGGATGAATGGAAGGAGGCTTAGGACTTTCCA
   CTCCTGGCTGAGAGAGGAAGAGCTGCAACGGAATTAGGAAGACCAAGACACAGATCACCCGGGCGTTACTTAGCCTACAGATGTCC
   TACGGGAACGTGGGCTGGCCCAGCATAGGGCTAGCAAATTTGAGTTGGATGATTGTTTTTGCTCAAGGCAACCAGAGGAAACTTGC
   ATACAGAGACAGATATACTGGGAGAAATGACTTTGAAAACCTGGCTCTAAGGTGGGATCACTAAGGGATGGGGCAGTCTCTGCCCA
   AACATAAAGAGAACTCTGGGGAGCCTGAGCCACAAAAATGTTCCTTTATTTTATGTAAACCCTCAAGGGTTATAGACTGCCATGCT
   AGACAAGCTTGTCCATGTAATATTCCCATGTTTTTACCCTGCCCCTGCCTTGATTAGACTCCTAGCACCTGGCTAGTTTCTAACAT
   GTTTTGTGCAGCACAGTTTTTAATAAATGCTTGTTACATTCAAAAAAAAAAAAAAAAAAAAAAAAAAAAAAAAAAAAAAAAAAAAA
   AAAAAAAAAAAAAAAAAAAAAAAAAAAAAAA

31 GAGGAACCGAGAGGCTGAGACTAACCCAGAAACATCCAATTCTCAAACTGAAGCTCGCACTCTCGCCTCCAGCATGAAAGTCTCTG
   CCGCCCTTCTGTGCCTGCTGCTCATAGCAGCCACCTTCATTCCCCAAGGGCTCGCTCAGCCAGATGCAATCAATGCCCCAGTCACC
   TGCTGTTATAACTTCACCAATAGGAAGATCTCAGTGCAGAGGCTCGCGAGCTATAGAAGAATCACCAGCAGCAAGTGTCCCAAAGA
   AGCTGTGATCTTCAAGACCATTGTGGCCAAGGAGATCTGTGCTGACCCCAAGCAGAAGTGGGTTCAGGATTCCATGGACCACCTGG
   ACAAGCAAACCCAAACTCCGAAGACTTGAACACTCACTCCACAACCCAAGAATCTGCAGCTAACTTATTTTCCCCTAGCTTTCCCC
   AGACACCCTGTTTTATTTTATTATAATGAATTTTGTTTGTTGATGTGAAACATTATGCCTTAAGTAATGTTAATTCTTATTTAAGT
   TATTGATGTTTTAAGTTTATCTTTCATGGTACTAGTGTTTTTTAGATACAGAGACTTGGGGAAATTGCTTTTCCTCTTGAACCACA
   GTTCTACCCCTGGGATGTTTTGAGGGTCTTTGCAAGAATCATTAATACAAAGAATTTTTTTAACATTCCAATGCATTGCTAAAAT
   ATTATTGTGGAAATGAATATTTTGTAACTATTACACCAAATAAATATATTTTTGTACAAAAAAAAAAAAAAA

32 GCGCAGCTCTTAGTCGCGGGCCGACTGGTGTTTATCCGTCACTCGCCGAGGTTCCTTGGGTCATGGTGCCAGCCTGACTGAGAAGA
   GGACGCTCCCGGGAGACGAATGAGGAACCACCTCCTCCTACTGTTCAAGTACAGGGGCTGGTCCGCAAAGGGAAGAAAAGCAAAA
   GACGAAAATGGCTAAATTCGTGATCCGCCCAGCCACTGCCGCCGACTGCAGTGACATACTGCGGCTGATCAAGGAGCTGGCTAAAT
   ATGAATACATGGAAGAACAAGTAATCTTAACTGAAAAAGATCTGCTAAGGATGGTTTAGGAGAGCACCCCTTTTACCACTGCCTG
   GTTGCAGAAGTGCCGAAAGAGCACTGGACTCCGGAAGGACACAGCATTGTGGTATAGCCATGTACTATATTACCTATGACCCGTGG
   ATTGGCAGCTATCGTATCTTGGAGGACTTCTTCGTGATGAGTGACTTATAGAGGCTTTGCATACCGATCAGAAATTCTGAAAGAA
   TCTAAGGCCAGGTTGCAATGAGGTGGTCGCTGGACGCCGCCTGCACCTTCTGGGTAGCAGCAATGGGATGCAGCCATTCCCTCAAC
   GTTCTTATTCAACGAAGACGGGGCTCAGAAACCGGCCAGCGACAGAGGGTTGAGACGGTCAAGACTCGACAGGGGTTCTGCAAACA
   AGTGCACACGAGAGTAGGAGGCCGCTGTGATAACCCTCTCATTCGAGAAATCCACACTCGACTACATCGTGTGCGAGAAAATATGC
   GCCCAGTTTCACGGGCGCGTATAGCTGCAAGACACAAGCAAGCACCATTTACCGGCGCTTGTTTCCGCGTCGACATACTCTGAGA
   CGGAAGCAGACACGACGAACGAGATCGCAGAAGCGAAAGAGCCACAGGCCAGCCAGCAGCAGAGCAGCAAGGCGGGTACACGTCGC
   CAACGACAAGGCCGGGATGCGCAGAGCAGTCGGAGGGAAGCAGGGGGATGAAGCAGACAACGAGAACGAAAGCAGACAACACAACG
   CTACCGAGAGACGAGAAGCAGAGAAATGGAAGGCACAGTGGAGAAGCAGCAGCGCGAGAAGAGCTGACAAGAGACGGAGAGAG
   AAGCAGACAGACGCGGAGCCGCGACCGGACGCCGGAGCGAGCGAAGGCCACAGCGGGCGAGCTAGAGCGAAGACAGGACGACCA
   GCGAGAAGGAAGGAGAAGCGGGAAGAGACAGGAGAGGGGAGCACGAGGGACGAACGGAGGAGCGACGGGGAGACAAGACGGAG
   CGAGCCGCGGCAGGGGAGGGCGAGCGCAGGAATAGAAGAGAAGAAGAGAGAACAACAACGAGGCGGAGAGAGGAGAGCGAGGAACA
   GACGCGTGGGACGGGAAGAGGGCGCACACGGGAAGGGCGAGGCGGAGCAGCGCAAGGGGCGAGGCGAGGAGGCCAAGCGCAAGGCAG
   AAGGAAGAGCGGAGAGAGGCGAGGAGGAACAGACACGAGACGCGCTGGGAGCGAGACAGGCGAAGGAGGGAAGGAGAGAGGCGAG
   TAAGAGAGGCAGGAGACGTAGAGAACAGGAGGGCGCGACGCCCACGGGAGAGGGAGGGCAGGAGAGAGGAAGGAAGCACGGCGAGG
   AACGGGAGGAACGAACGACGAGCGGGGCAGCGGGCGAGGACGAGGAGGG

33 GCCTGTCTGCATTCTACTATATAAAGCAGCAGAGACGTTGACTAGCGCATATTTGCTAAGAGCACCATGCGCGCAGCAGCCATCTC
   CACTCCAAAGTTAGACAAAATGCCAGGAATGTTCTTCTCTGCTAACCCAAAGGAATTGAAAGGAACCACTCATTCACTTCTAGACG
   ACAAAATGCAAAAAGGAGGCCAAAGACTTTTGGAATGGATATGAAAGCATACCTGAGATCTATGATCCCACATCTGGAATCTGGA
   ATGAAATCTTCCAAGTCCAAGGATGTACTTTCTGCTGCTGAAGTAATGCAATGGTCTCAATCTCTGGAAAAACTTCTTGCCAACCA
   AACTGGTCAAAATGTCTTTGGAAGTTTCCTAAAGTCTGAATTCAGTGAGGAGAATATTGAGTTCTGGCTGGCTTGTGAAGACTATA
```

TABLE 1-continued

Sequences Table. First column: SEQ ID No. Second column: corresponding mRNA sequence. For the 3 different groups, see explanation in the text.

|   |   |
|---|---|
|   | AGAAAACAGAGTCTGATCTTTTGCCCTGTAAAGCAGAAGAGATATATAAAGCATTTGTGCATTCAGATGCTGCTAAACAAATCAAT<br>ATTGACTTCCGCACTCGAGAATCTACAGCCAAGAAGATTAAAGCACCAACCCCCACGTGTTTTGATGAAGCACAAAAAGTCATATA<br>TACTCTTATGGAAAAGGACTCTTATCCCAGGTTCCTCAAATCAGATATTTACTTAAATCTTCTAAATGACCTGCAGGCTAATAGCC<br>TAAAGTGACTGGTCCCTGGCTGAAGGGAATTAACAGATAGTATCAAGCGCAGAAGGAATGTGCCAGTATGGCTCCCTGGGTGAACA<br>GCTTGGCCTTTTTTGGGTGTCTTGACAGGCCAAGAAGAACAAATGACTCAGAATGGATTAACATGAAAGTTATCCAGGCGCAGAGT<br>TGAAGAAGCATAAGCAAGACAAAAACAGAGAGACCGCAGAAGGAGGAAGATACTGTGGTACTGTCATAAAAACAGTGGAGCTCTG<br>TATTAGAAAGCCCCTCAGAACTGGGAAGGCCAGGTAACTCTAGTTACACAGAAACTGTGACTAAAGTCTATGAAACTGATTACAAC<br>AGACTGTAAGAATCAAAGTCAACTGACATCTATGCTACATATTATTATATAGTTTGTACTGAGCTATTGAAGTCCCATTAACTTAA<br>AGTATATGTTTTCAAATTGCCATTGCTACTATTGCTTGTCGGTGTTATTTTATTTGTTTTTGACTTTGGAAGAGATGAACTG<br>TGTATTTAACTTAAGCTATTGCTCTTAAAACCAGGGAGTCAGAATATATTTGTAAGTTAAATCATTGGTGCTAATAATAAATGTGG<br>ATTTTGTATTAAAATATATAGAAGCAATTTCTGTTTACATGTCCTTGCTACTTTTAAAAACTTGCATTTATTCCTCAGATTTTAAA<br>AATAAATAAATAATTCATTTAAGATTC |
| 34 | GTATGCATCTTTTGCTTTCTAGCTCATATTTCTGAGCTGTGAAATGTAAAGTATTTAGATATATTTATGTGAGTGGTGTTTGAAAG<br>TCTGGAAAATGAGAAGTGTAGCATGGATGTGTTATAGCTTCTTTCAGTCCACAACAGGACTGCTTTCCAAATTGGCTAATGGCTAA<br>TAGAAGGGCAGATTTTCCATCAAAACAAAAAGAATTATTTAGGGCAAAAAGCAAATGACATTTTCTGTGAGTTTGAGTTTTTAACT<br>GAGGTACTTCTCATGCAACTAGAGTGGTTGGGGGTATTGTCAAGCACGAGAATTTTTGGTTTTTACAAAAGGCTAAGTGAATAGGA<br>AGATGCCTCTGGTGAAGATGTGTGTCACATGCAGGACCATGTGAAAAGATCAGAGAGGAGATTTATTCAGATGATGTTTGAAGAGT<br>TTTAGGTTAACTGTGTACGAAAGATTTGAAACAGCCAGAAAGTATCAACATTTGTGGTATGCTTCATAAACAGTAGAGTGAGAATT<br>TTTTCTTTTGTCTATTATGGAAAGCTGAATAAAATATTTTCTGAAGGAAAAAATAAAACACTCAGTTGACTTTCAAAAATCTTAAC<br>AGTCTAGTGACCAGGCACGGTGGCTCATGCCTGTAATCCTAGCAGTCTGGGAGCCGAGGCAGATGGATCGGGCAGATCGCTTGAA<br>CTGGGAGTTCGAGACCAGCCTGGGCAACGTGGCGAAACCCTGTCTCTGCCAAAAATACACAAAGTAGCTGAGCATGGTGGTGCATG<br>CCTGTGGTCCTAGCTTCTCGGGAGGCTAAGGCAGGAGGATCACTTGAGTCTGGGAGGCAGAGGTTGCAGTGAGCGAGATCATGCC<br>ACTGCACTCCAGCCTGGGTGACAAAGTGAGACCCCATCTCAAAAAAAAAAAAATCTTAATAGTCTAGATATAGAAAAAAGGTGAA<br>AATTATACATATATAAAATGTTTGGGGGGGGGTTACGTGCATTGGAACTTTCACATAAGGGGGTTAGTGACAATCAGATTTATGT<br>AAGAATGATGAAATGTTTGAAAAATTCTGTGATGACAGATAAACATTATACCATAAATTTGTTGAAATCATAACACAGTTCTAGCT<br>TTTAGTTTATGTTCTGTGGATTTCTTGTGTGTGTTTACGGGTGTTTTTATATATGTATGTATGTATGATTGTTCCTCCAAATCACC<br>CACCTCATTCTGGATATTTACTAATCAGATTAGGTTTAGCTCTACTAGAAACTTACCCTTAGAGTGAAAAACTACTTGATGCCAAT<br>GATGATCTGCGGGATAAAAGCGAAGCAATGAGAGACTGCACAAAAGGAGACCGCTCCAAAAATATTGCGCAATGATGGAGTCACTG<br>GGAAAAAAAAGACTGTCTACTGCAGGCAGAAATGTACACTCCTAAGCTAGAGGCTAATTGTTTGAATAAATATAGCATCTTAAAT<br>TTCCTTTCATAAATAAAACATAGTGATAGAAGAAAGATGAAGCCCAGGAGTGCTATGTGAGCACTTAATCTGACACGAAGGAGAAA<br>ATCACAGAAAGAAAGCCTTCTTATAGAGAAGTCACCTCATTCTCCCAAGAAGCTAGGACCACAGGCATGTGCCACCATGCCCAGCT<br>ACTTTTTGCATTTTTAGTAGAGACAGAATTTTGCCGTGTTGCCCAGGCTGGACTCAAACTCCTGAGCTGGAGTGATCTGCCTGCCT<br>CAGCCTCCCAAAGCACTAGGATTACAGGCGTGTTCTTCTGGACACTCATGCCCTCTGTCTGCTCTGTATGCCTGTTGGGTGATTTG<br>CTCTACTTGCCAGCTTTGCTGTAAAAAGAAAAAAAAAAAAAAAAGGGGCAGTAAGTATAACTGCTTATGCGAGTGTGCATTTTGG<br>TGGAGGAGTTTTATAAATGATAGACAAAATTCCCCTTTAGGCTCTATTTAATCTTTCAGATAGTAAATCCAGATTTGCCCCCAGAT<br>GTAAGACGTCATGTGACTAGTAGCTTGTGACTGTGTAAGTCATCGGTTTCACTTTATGTATGGATAGGATTACACGCAGAGGTGAA<br>AGGTGAAACGCTGGTTAAGAGTACAAGTTTCAAGTTTGCTCTGCTTCCATACAAATATAATAGAAGCAGCTTCTGTAGAATTTC<br>CTTAGCAGTAAACCAGACGTGTTCCAAGAGAATAACAGTAATAAAAAAATTTAGGTTAAAAATCTTAGAGTTAAGGCTTAAAGTAC<br>TGCCTAAATGTCACTAAGGTACACTTCTGAGCTGGCCTGCAGCTAACTTCAGATCTGACTTTTGCTTGAATTGCAGTCATCCGAAT<br>TTCACTAGGAACATAGGCAAAAGATAACTTTTGCAAATAAATTTCATCATTTCACCTTTATGGCAAATAATGGATTTCTAATATGA<br>AACTTTAATAATATTAACATATGGGAATTACATTAACATGTGACTAGTTACTACATCATTGGAATTTTAACCAACTGCTTCCAAAT<br>ACAGTTAGAGAATTTTATAATTATTTGATATAATGGGGATAGCTGGGACTGAATGTCACTCGGACATTCAAAAGATCAATACTTGA<br>ATTAAAGTTAACACTTATCTTGGGAGTGGAGGTAAAAAAAAAAAAAAAAA |
| 35 | AGAATGTTCTTTTGGCCACTGTGAAGCCTCAGGAAGGGGCTCGGATTGCTCAAGGACCCATGGGAGAGAGGAGGCTTTGACTGGGC<br>TGCCTGCCTGTGAGGTCTCTGGACTAGAGGTCCAACGCAGTCCAGCTGACAAGGATGGAATACGCCATGAAGTCCCTTAGCCTTCT<br>CTACCCCAAGTCCCTCTCCAGGCATGTGTCAGTGCGTACCTCTGTGGTGACCCAGCAGCTGCTGTCGGAGCCCAGCCCCAAGGCCC<br>CCAGGGCCCGGCCCTGCCGCGTAAGCACGGCGGATCGAAGCGTGAGGAAGGGCATCATGGCTTACAGTCTTGAGGACCTCCTCCTC<br>AAGGTCCGGGACACTCTGATGCTGGCAGACAAGCCCTTCTTCCTGGTGCTGGAGGAAGATGGCACAACTGTAGAGACAGAAGAGTA<br>CTTCCAAGCCCTGGCAGGGGATACAGTGTTCATGGTCCTCCAGAAGGGCAGAAATGGCAGCCCCCATCAGAACAGGGGACAAGGC<br>ACCCACTGTCCCTCTCCCATAAGCCTGCCAAGAAGATTGATGTGGCCCGTGTAACGTTTGATCTGTACAAGCTGAACCCACAGGAC<br>TTCATTGGCTGCCTGAACGTGAAGGCGACTTTTTATGATACATACTCCCTTCCTATGATCTGCACTGCTGTGGGGCCAAGCGCAT<br>CATGAAGGAAGCTTTCCGCTGGGCCTCTTCAGCATGCAGGCCACAGGCCACGTACCTGGCCACCTCCTGTTACCTGCAGCAGC<br>TCCTCGATGCTACGGAGGAAGGGCAGCCCCCCAAGGGCAAGGCCTCATCCCTTATCCCGACCTGTCTGAAGATACTGCAGTGAAAG<br>CCCAAGTCCTTGGAAGCTTTCCCCAGTGAAGGACTGACTGGGGGCCTCACGCTTAACTGGTAGTGCCCACAAGCCTGGCAGCTGTA<br>GAGCCGCGAACCTCCCCACACCTCCCTCACCGCGCAGGACCCTGAGTGAGGAGGAGGAGCTGGAAACCTGGGGTGGGTTGGCCAAA<br>GGAGAACCTCAAGCTCCTGGCCTGATCCAGCTCCTTCCTGCCCAAGGCAGCTTAGCCCATCCAGACTGGTCCTGAAGTCTGTCCCT<br>CCATTGGCATGAAGTCTGCCCCTTAGCAATCCGGCCTCGCAGGCTGTACTTTCATGGTGCTCTCTACCTTCTGGCCCCATCCGG<br>AACATTCCTGAGTGAATTCGCAAGCGCACTAGCATGTGATATTAGGGAGTTTGCAATAAATTATTGAGGCTGAAAAAAAAAAAAAA<br>AAAAAAAAAAAAAAA |
| 36 | CTGCTGGAGTAGGCACCCATTTAAAGAAAAAATGAAGAAGCAGCAATAAAGAAGTTGTAATCGTTACCTAGACAAACAGAGAACTG<br>GTTTTGACAGTGTTTCTAGAGTGCTTTTTATTATTTTCCTGACAGTTGTGTTCCACCATGATTACTTTCTCCTTCAGCGAATAGGC<br>TAAATGAATATGAAACAGAAAAGCGTGTATCAGCAAACCAAAGCACTTCTGTGCAAGAATTTTCTTAAGAAATGGAGGATGAAAAG<br>AGAGAGCTTATTGGAATGGGGCCTCTCAATACTTCTAGGACTGTGTATTGCTCTGTTTTCCAGTTCCATGAGAAATGTCCAGTTTC<br>CTGGAATGGCTCCTCAGAATCTGGGAAGGGTAGATAAATTTAATAGCTCTTCTTTAATGGTTGTGTATACACCAATATCTAATTTA<br>ACCCAGCAGATAATGAATAAAACAGCACTTTGCTCCTCTTTTGAAAGGAACAAGTGTCATTGGGGCACCAAATAAAACACACATGGA<br>CGAAATACTTCTGGAAAATTTACCATATGCTATGGGAATCATCTTTAATGAAACTTTCTCTTATAAGTTAATATTTTTCCAGGGAT<br>ATAACAGTCCACTTTGGAAAGAAGATTTCTCAGCTCATTGCTGGGATGGATATGGTGAGTTTTCATGTACATTGACCAAATACTGG<br>AATAGAGGATTTGTGGCTTTACAAACAGTCTATTAATACTGCCATTATAGAAATCACAAACCAATCACCCTGTACTGGAGGAGTTGAT<br>GTCAGTTACTGCTATAACTATGAAGACATTACCTTTCATAACTAAAAATCTTCTTCACAATGAGATGTTTATTTTATTCTTCTTGC<br>TTCATTTCTCCCCACTTGTATATTTTATATCACTCAATGTAACAAAAGAGAGAAAAAGTCTAAGAATTTGATGAAAATGATGGGT<br>CTCCAAGATTCAGCATTCTGGCTCTCCTGGGGTCTAATCTATGCTGGCTTCATCTTTATTTTTCCATATTCGTTACAATTATCAT<br>AACATTCACCCAAATTATAGTCATGACTGGCTTCATGGTCATATTTATACTCTTTTTTTTATATGGCTTATCTTTGGTAGCTTTGG<br>TGTTCCTGATGAGTGTGCTGTTAAAGAAAGCTGTCCTCACCAATTTGGTTGTGTTTCTCCTTACCCTCTTTTGGGGATGTCTGGGA |

TABLE 1-continued

Sequences Table. First column: SEQ ID No. Second column: corresponding mRNA sequence. For the 3 different groups, see explanation in the text.

```
   TTCACTGTATTTTATGAACAACTTCCTTCATCTCTGGAGTGGATTTTGAATATTTGTAGCCCTTTTGCCTTTACTACTGGAATGAT
   TCAGATTATCAAACTGGATTATAACTTGAATGGTGTAATTTTTCCTGACCCTTCAGGAGACTCATATACAATGATAGCAACTTTTT
   CTATGTTGCTTTTGGATGGTCTCATCTACTTGCTATTGGCATTATACTTTGACAAAATTTTACCCTATGGAGATGAGCGCCATTAT
   TCTCCTTTATTTTTCTTGAAGTTCATCATCTTGTTTCCAACACCAAAGGACTAATGCTAAGGTTATTGAGAAAGAAATCGATGCTGA
   GCATCCCTCTGATGATTATTTTGAACCAGTAGCTCCTGAATTCCAAGGAAAAGAAGCCATCAGAATCAGAAATGTTAAGAAGGAAT
   ATAAAGGAAAATCTGGAAAAGTGGAAGCATTGAAAGGCTTGCTCTTTGACATATATGAAGGTCAAATCACGGCAATCCTGGGTCAC
   AGTGGAGCTGGCAAATCTTCACTGCTAAATATTCTTAATGGATTGTCTGTTCCAACAGAAGGATCAGTTACCATCTATAATAAAAA
   TCTCTCTGAAATGCAAGACTTGGAGGAAATCAGAAAGATAACTGGCGTCTGTCCTCAATTCAATGTTCAATTTGACATACTCACCG
   TGAAGGAAAACCTCAGCCTGTTTGCTAAAATAAAAGGGATTCATCTAAAGGAAGTGGAACAAGAGGTACAACGAATATTATTGGAA
   TTGGACATGCAAAACATTCAAGATAACCTTGCTAAACATTTAAGTGAAGGACAGAAAAGAAAGCTGACTTTTGGGATTACCATTTT
   AGGAGATCCTCAAATTTTGCTTTAGATGAACCAACTACTGGATTGGATCCCTTTTCCAGAGATCAAGTGTGGAGCCTCCTGAGAG
   AGCGTAGAGCAGATCATGTGATCCTTTTCAGTACCCAGTCCATGGATGAGGCTGACATCCTGGCTGATAGAAAAGTGATCATGTCC
   AATGGGAGACTGAAGTGTGCAGGTTCTTCTATGTTTTTGAAAAGAAGGTGGGGTCTTGGATATCACCTAAGTTTACATAGGAATGA
   AATATGTAACCCAGAACAAATAACATCCTTCATTACTCATCACATCCCCGATGCTAAATTAAAAACAGAAAACAAAGAAAACCTTG
   TATATACTTTGCCACTGGAAAGGACAAATACATTTCCAGATCTTTTCAGTGATCTGGATAAGTGTTCTGACCAGGGAGTGACAGGT
   TATGACATTTCCATGTCAACTCTAAATGAAGTCTTTATGAAACTGGAAGGACAGTCAACTATCGAACAAGATTTCGAACAAGTGGA
   GATGATAAGAGACTCAGAAAGCCTCAATGAAATGGAGCTGGCTCACTCTTCCTTCTCTGAAATGCAGACAGCTGTGAGTGACATGG
   GCCTCTGGAGAATGCAAGTCTTTGCCATGGCACGGCTCCGTTTCTTAAAGTTAAAACGTCAAACTAAAGTGTTATTGACCCTATTA
   TTGGTATTTGGAATCGCAATATTCCCTTTGATTGTTGAAAATATAATGTATGCTATGTTAAATGAAAAGATCGATTGGGAATTTAA
   AAACGAATTGTATTTTCTCTCTCCTGGACAACTTCCCCAGGAACCCCGTACCAGCCTGTTGATCATCAATAACACAGAATCAAATA
   TTGAAGATTTTATAAAATCACTGAAGCATCAAAATATACTTTTGGAAGTAGATGCTTTGAAAACAGAAATGGTACTGATGGCCTC
   TCATACAATGGAGCTATCATAGTTTCTGGTAAACAAAAGGATTATAGATTTTCAGTTGTGTGTAATACCAAGAGATTGCACTGTTT
   TCCAATTCTTATGAATATTATCAGCAATGGGCTACTTCAAATGTTTAATCACACACAACATATTCGAATTGAGTCAAGCCCATTTC
   CTCTTAGCCACATAGGACTCTGGACTGGGTTGCCGGATGGTTCCTTTTTCTTATTTTTGGTTCTATGTAGCATTTCTCCTTATATC
   ACCATGGGCAGCATCAGTGATTACAAGAAAAATGCTAAGTCCCAGCTATGGATTTCAGGCCTCTACACTTCTGCTTACTGGTGTGG
   GCAGGCACTAGTGGACGTCAGCTTCTTCATTTTAATTCTCCTTTTAATGTATTTAATTTTCTACATAGAAAACATGCAGTACCTTC
   TTATTACAAGCCAAATTGTGTTTGCTTTGGTTATAGTTACTCCTGGTTATGCAGCTTCTCTTGTCTTCTTCATATATATGATATCA
   TTTATTTTTCGCAAAAGGAGAAAAACAGTGGCCTTTGGTCATTTTACTTCTTTTTTGCCTCCACCATCATGTTTTCCATCACTTT
   AATCAATCATTTTGACCTAAGTATATTGATTACCACCATGGTATTGGTTCCTTCATATACCTTGCTTGGATTTAAAACTTTTTTGG
   AAGTGAGAGACCAGGAGCACTACAGAGAATTTCCAGAGGCAAATTTTGAATTGAGTGCCACTGATTTTCTAGTCTGCTTCATACCC
   TACTTTCAGACTTTGCTATTCGTTTTTGTTCTAAGATGCATGGAACTAAAATGTGGAAAGAAAAGAATGCGAAAAGATCCTGTTTT
   CAGAATTTCCCCCCAAAGTAGAGATGCTAAGCCAAATCCAGAAGAACCCATAGATGAAGATGAAGATATTCAAACAGAAAGAATAA
   GAACAGCCACTGCTCTGACCACTTCAATCTTAGATGAGAAACCTGTTATAATTGCCAGCTGTCTACACAAAGAATATGCAGGCCAG
   AAGAAAAGTTGCTTTTCAAAGAGGAAGAAGAAAATAGCAGCAAGAATTATCTCTTTCTGTGTTCAAGAAGGTGAAATTTTGGGATT
   GCTAGGACCCAATGGTGCTGGAAAAAAGTTCATCTATTAGAATGATATCTGGGATCACAAAGCCAACTGCTGGAGAGGTGGAACTGA
   AAGGCTGCAGTTCAGTTTTGGGCCACCTGGGGTACTGCCCTCAAGAGAACGTGCTGTGGCCCATGCTGACGTTGAGGGAACACCTG
   GAGGTGTATGCTGCCGTCAAGGGGCTCAGGAAAGCGGACGCGAGGCTCGCCATCGCAAGATTAGTGAGTGCTTTCAAACTGCATGA
   GCAGCTGAATGTTCCTGTGCAGAAATTAACAGCAGGAATCACGAGAAGGTTGTGTTTTGTGCTGAGCCTCCTGGGAAACTCACCTG
   TCTTGCTCCTGGATGAACCATCTACGGGCATAGACCCCACAGGGCAGCAGCAAATGTGGCAGGCAATCCAGGCAGTCGTTAAAAAC
   ACAGAGAGAGGTGTCCTCCTGACCACCCATAACCTGGCTGAGGCGGAAGCCTTGTGTGACCGTGTGGCCATCATGGTGTCTGGAAG
   GCTTAGATGCATTGGCTCCATCCAACACCTGAAAAACAAACTTGGCAAGGATTACATTCTAGAGCTAAAAGTGAAGGAAACGTCTC
   AAGTGACTTTGGTCCACACTGAGATTCTGAAGCTTTTCCCCACAGGCTGCAGGGCAGAAAGGTATTCCTCTTTCTTAACCTATAAG
   CTGCCCGTGGCAGACGTTTACCCTCTATCACAGACCTTTCACAAATTAGAAGCAGTGAAGCATAACTTTAACCTGGAAGAATACAG
   CCTTTCTCAGTGCACACTGGAGAAGGTATTCTTAGAGCTTTCTAAAGAACAGGAAGTAGGAAATTTTGATGAAGAATTGATACAA
   CAATGAGATGGAAACTCCTCCCTCATTCAGATGAACCTTAAAAACCTCAAACCTAGTAATTTTTTGTTGATCTCCTATAAACTCATG
   TTTTATGTAATAATTAATAGTATGTTTAATTTTAAAGATCATTTAAAATTAACATCAGGTATATTTTGTAAATTTAGTTAACAAAT
   ACATAAATTTTAAAATTATTCTTCCTCTCAAACATAGGGGTGATAGCAAACCTGTGATAAAGGCAATACAAAATATTAGTAAAGTC
   ACCCAAAGAGTCAGGCACTGGGTATTGTGGAAATAAAACTATATAAACTT

37 GCATAACTGATGGAGGGCCGGGCGCGGTAAGAGCGTCTCGGGGGAGTGGGGCAAGGCGGCCGGGCCCCTCCCATTCCGCCTTTTCT
   TCAGCGTCCTACCCGCGCGCACTGGCTGCGAGCGCCGGGCCACCTGCGAGTGTGCGCAGGGACTCTGGACACCCGCGGCGGCGAGCT
   GAGGGAGCAGTCTCCACGAGGACCCAGGCGGACCCTCTGGCGCCATGCGCGCCCTCCCCGGCCTGCTGGAGGCCAGGGCGCGTACG
   CCCCGGCTGCTCCTCCTCCAGTGCCTTCTCGCTGCCGCGCGCCCAAGCTCGGCGGACGGCAGTGCCCCAGATTCGCCTTTTACAAG
   TCCACCTCTCAGAGAAGAAATAATGGCAAATAACTTTTCCTTGACAGATATCACTGACTGAACATTCTAGTATGCCAG
   TAGAAAAAAATATCACTTTAGAAAGGCCTTCTAATGTAAATCTCACATGCCAGTTCACAACATCTGGGGATTTGAATGCAGTAAAT
   GTGACTTGGAAAAAGATGGTGAACAACTTGAGAATAATTATCTTGTCAGTGCAACAGGAAGCACCTTGTATACCCAATACAGGTT
   CACCATCATTAATAGCAAACAATGGGAAGTTATTCTTGTTTCTTTCGAGAGGAAAAGGAACAAAGGGGAACATTTAATTTCAAAG
   TCCCTGAACTTCATGGGAAAAACAAGCCATTGATCTCTTACGTAGGGGATTCTACTGTCTTGACATGTAAATGTCAAAATTGTTTT
   CCTTTAAATTGGACCTGGTACAGTAATGGGAGTGTAAAGGTTCCTGTTGGTGTTCAAATGAATAAATATGTGATCAATGGAAC
   ATATGCTAACGAAACAAAGCTGAAGATAACACAACTTTTGGAGGAAGATGTGGGAATCTTACTGGTGCCGTGCACTATTCCAATTAG
   GCGAGAGTGAAGAACACATTGAGCTTGTGGTGCTGAGCTATTGGTGCCCCTCAAACCATTTCTTGTAATAGTGGCTGAGGTGATT
   CTTTTAGTGGCCACCATTCTGCTTTGTGAAAAGTACACACAAAAGAAAAGAAGCACTCAGATGAGGGGAAGAATTTGAGCAGAT
   TGAACAGCTGAAATCGATGATAGCATGATAGCAATGGTATAGAAAAATAGTGTCTCCCAGGCCATAGAAAATGAGTCTCTGGGGCCAGTGAATAC
   AAAACATCATGTCAGAATCATTGGAAGATATACAGAGTTCGTATTTCAGCTTTGTTTATCCTTCCTGTTAAGAGCCTCTGAGTTT
   TTAGTTTTAAAGGATGAAAGCTTATGCAACATGCTCAGCAGGAGCTTCATCAACGATATATGTCAGATCTAAAGGTATATTTTC
   ATTCTGTAATTATGTTACATAAAAGCAATGTAAATCAGAATAAATATGTTAGACCAGATAAAATTAATTATATTCTGGTCTTCAA
   AGGACACACAGAACAGATATCAGCAGAATCACTTAATACTTCATAGAACAAAAATCACTCAAAACCTGTTTATAACCAAAGAATTC
   ATGAAAAAGAAAGCCTTTGCCATTTGTCTTAGAAAGTTATTTTTTAAAAAAAATCATACTTACTATTAGTATCTATGGAAGTATA
   TGTAACAATTTTATGTAAAGGTCATCTTCTGTGATAGTGAAAAATATGTCTTTACTAAGTTGAAATGAATACTTTCTGCCTTT
   GCTAATGATAGTTATTCTACAATCTCCACAAGAAAAATATACCTTTTATCCGGAAATATTGGTTTAAGGCAAATAAATAAAACTGT
   GCTTGCTCTAAAGCTCTGCACTACAAAAAAAAAAAAAAAA

38 GTGGACGCAGCGGGCTTTGGAAAGGCCCCAAGTTAATGAGGCGTGCGCCGGCTGCCGAGCGCCTCTTGGAGCTGGGCTTTCCCCCG
   CGGTGCGGGCGCCAGGAGCCGCCTTTTCCGCTGGGTGTCACTCGGGGGTGGGGAAGATGGCCCATTCAAAAGCGCCGCGAGGGGGC
   CCGGCCAGTGCCCTTCAGTGAGCGCTCGCAAGAGGACGGCAGAGGCCCGGCAGCTCGGAGCTCCGGGACCTTGTGGCGCATCAGGA
   CGCGGCTGTCCCTCTGCCGGGACCCAGAGCCGCCGCCGCCGCTCTGCCTCCTGCGTGTTAGCCTCCTCTGCGCGCTCCGGGCAGGC
```

TABLE 1-continued

Sequences Table. First column: SEQ ID No. Second column: corresponding mRNA sequence. For the 3 different groups, see explanation in the text.

| | |
|---|---|
| | GGCCGTGGGAGCCGCTGGGGCGAGGACGGCGCGAGGCTGCTGCTGCTGCCCCCGGCCCGCGCGGCTGGAAACGGAGAGGCCGAGCC |
| | AAGCGGCGGCCCCTCTTATGCTGGGAGGATGCTGGAGAGTAGCGGCTGCAAAGCGCTGAAGGAGGGCGTGCTGGAGAAGCGCAGCG |
| | ACGGGTTGTTGCAGCTCTGGAAGAAAAAGTGTTGCATCCTCACCGAGGAAGGGCTGCTGCTTATCCCGCCCAAGCAGCTGCAACAC |
| | CAGCAGCAGCAGCAGCAACAGCAGCAGCAGCAGCAACAACAGCCCGGGCAGGGGCCGGCCGAGCCGTCCCAACCCAGTGGCCC |
| | CGCTGTCGCCAGCCTCGAGCCGCCGGTCAAGCTCAAGGAACTGCACTTCTCCAACATGAAGACCGTGGACTGTGTGGAGCGCAAGG |
| | GCAAGTACATGTACTTCACTGTGGTGATGGCAGAGGGCAAGGAGATCGACTTTCGGTGCCCGCAAGACCAGGGCTGGAACGCCGAG |
| | ATCACGCTGCAGATGGTGCAGTACAAGAATCGTCAGGCCATCCTGGCGGTCAAATCCACGCGGCAGAAGCAGCAGCACCTGGTCCA |
| | GCAGCAGCCCCCCTCGCAGCCGCAGCCGCAGCCGCAGCTCCAGCCCCAACCCCAGCCTCAGCCTCAGCCGCAACCCCAGCCCCAAT |
| | CACAACCCCAGCCTCAGCCCCAACCCAAGCCTCAGCCCCAGCAGCTCCACCGTATCCGCATCCACATCCACATCCACACTCTCAT |
| | CCTCACTCGCACCCACACCCTCACCCGCACCCGCATCCGCACCAAATACCGCACCCACACCCACAGCCGCACTCGCAGCCGCACGG |
| | GCACCGGCTTCTCCGCAGCACCTCCAACTCTGCCTGAAAGGGGCAGCTCCCGGGCAAGACAAGGTTTTGAGGACTTGAGGAAGTGG |
| | GACGAGCACATTTCTATTGTCTTCACTTGGATCAAAAGCAAAACAGTCTCTCCGCCCCGCACCAGATCAAGTAGTTTGGACATCAC |
| | CCTACTGAAAACTTGCGATTCTTCTTAGTTTTCTGCATACTTTTCATCACGATGCAGGAAACGATTTCGAGTCAAGAAGACTTTTA |
| | TTTATGAACCTTTGAAAGGATCGTCTTGTATGGTGAATTTTCTAGGAGCGATGATGTACTGTAATTTTATTTTAATGTATTTTGAT |
| | TTATGATTATTTATTAGTTTTTTTTTAAATGCTTGTTCTAAGACATTTCTGAATGTAGACCATTTTCCAAAAAGGAAACTTTATTT |
| | TCAAAAACCTAATCCGTAGTAATTCCTAATCTTGGAGAATAAAAAAGGGCGGTGGAGGGGAAAACATTAAGAATTTATTCATTATT |
| | TCTCGAGTACTTTCAGAAAGTCTGACACTTTCATTGTTGTGCCAGCTGGTTGAAATTAAAACTCTGATATTACTTTTTTTGAGGAT |
| | TTTTATTTTTGTTTTTGCTTAAACATATAGTTTGTCTAGAAGTTTAAAAAGCTAAAAGTTAAAAATGGTGTAATTATGAAAATCTA |
| | ACACTCAAGATAGTTTCTAAAAGGAAATCAGTAGTTAAGGATACCTGATTTCAAATATTTAAAGCATAACCTAACTGATGGTAGG |
| | ATGATTGTATCTTGAATATGTGGTAGGGCCACATCTATTGTAGGAAAACCTTGCTTTTATCATCTGTGTGTAAAGGGCTTAATAAG |
| | GAGAAGAGGCCTTTTGACTGATTTGTGAGTATAAATGCATTTGCTTTCAAAATGTTGTGGAGGAAAAGAGTACATTTA |
| | ACTTGTATAAGAGAATATTTGTACTCCTGTCCAGGCTGCAGGACCCTTCTTCGAGAGCTTTGCACACTTGACTTGAACCACATTTT |
| | CTGATCCCTTTACTTTGTTTTAGAAGCACACTGAAAAATCTCGTTGTTTAAAGTACAATTTGTAAATATTTCAAAGGTCTAGGAGT |
| | CATAACTTTTGTTTTCATACTGAAATGATGTTGATCAGAGAAACCAACTGTTTTGCTTTTCATTGCTCTGTGAGAAATTTGAGGA |
| | TTCTGTTTTGCTGTTAGGTAAGCTAAACTCAGAAATTGAAAAGGAAAAGACTGGATAAACACAGGATTTTCAGTAAGAAAACAACC |
| | CCAGTCTTGTCTTAGAAGCCACTTGTTGAGGAGTCTGTTGGGGGAAAAAAGAGGATATGCTTTTAAAGGTAGAACAAACCTTCTTC |
| | TGTGTTAAATCAAAAGGATGTTCAAAATCCACCAGGACAGATGCTACTTGGGTTTAAATGGAGCCATAGATGATACAAAGTCCTCT |
| | TGGGGCTGAAAATCACTTCCTATTTGCATGGCTTTACTAACTGGTTTCTGTTTTCCATTATCTTTTTCACAGAAAGTCTTGGTCAG |
| | TATTTTTCCAGCATTTAAATTGAAACGGTCAGTATTAGACCACTGCTAGGTTTATGTAGTCAAGAAATAAAAATAGAATTACATGCT |
| | ACAGATGTCTTTATTCTCCTTCCATCTAGAAAGGAGTTCCAAGGTCAAATTACTTTTTAGTGCAATAGTTAAATGACATTTTGAGA |
| | TCATAACTCATATCCAAAAAGTTGCAGGGAAAATTAAAATAGCTTTCCCCTATTAAGCTAATGGCAAACAAAACTTAAGTGGACCC |
| | CCACTTCCAGTGGTTGTTTAGGTTGCAGTTGTGAAAATATGCTGCCAACATTTAAAAACTTGTTTCATATGTATATATGTATACAC |
| | ATATATGAATATGTATGTATATATACATATATGAGAACATGTGTGTACACATATATGAATATGTATATATGTGTATGTATGTATAT |
| | ATGTATATGAAATGAGAGCCACATCTAAAGATTTCTTAAATCAAGTTTGGTTCAGCTTCCTTAGAACTGTGGCTGTACTTTTTGAG |
| | GAGTACCTCATAGTACTATATTTTAATGCATGCAAATCATAATAGCTCCAAATGAACCACAGTTTTTTCCCAATGGAGGATTTTT |
| | TTTTAATTCTTGTACTAAAAAAAAAAAAATCCATACCAAATATTTTTACAAATTAAGATTGATGTAGGTTTTAAAAAAGGCATTTGT |
| | ATGTTGTTAGCTTACATATGGGGCTAGGTAATTTCATTGCTTAAAAAGATGCGCCTAGGCTCCCTCTTGGTGGCTGGATTTCTTTT |
| | TCTTCGCCCGTGGTGGCCATGGTTCTTAATAGGGCCACCGGAATCATGGTTTCTTTTTTTTTTTTTTTTGAGATGGAGTCTCG |
| | CCCTGTGACCCAGGCTGGAGTGCAGTGGCACGATCTCGGCTCACTGCAACCTCTGCCTCCTGGGTTCACGCCATTCTCCTGTCTCA |
| | GCCTCCTGAGTAGCTGGGACTACAGGTGAATGCCACCACGCCCGGCTGATTTTTGTATTTTTAGTAGAGATGGGGTTTCACCATAG |
| | TGGTCAGGCTGTTCTCGAACTCCTGACCTCAGGTGATCCACCTGCCTTGGCCTCCCAAAGTGCTAGGATTACAGGTGTGAGCCACC |
| | ACACCCGGCCCCAGAATAATGGTTTCTTGACTTTCTGTAGCCCTTGTTCCTTAGTCTGCTGTGATATTTATGTTGACCTTTATCAT |
| | TTTCTATTCTGAACCCCTCTTAGCATTTAATGTGAAATCTAAGAAATTAGAAGTAGAATGGCTTTTATTGTTTTGACACCTTTGAA |
| | ATTATTATTAATAATTTTTCCAGAGCAAAAAGCAAACACGCTCAATAAGACTAAACAAACAAATATAAATGTACATCATTTAA |
| | TGTCCCAGTGGCTCTATTCTACCTGTAAGAAAATGATACAAAACCACCTAAGATATTTTGAAGCCTGACAAATCAGCTTCATGGAA |
| | AAAGGTAAAAAATGCATTTTTCAACCGAAAGGGCAGATCCAATAGAAGACCCGCTCCTTAAATAAACATAAAATGTAAAAAGTTGG |
| | AAAATTAAGAGTAATGTTCCATCTGGAAACTGAACTTTTGTCCTTGAACTTGTGTTGGCACCAAGCCTCATACACAGTGAGCTCAA |
| | TAACTGTTGGGACAAAGGAAGGAAGGACAAAATGTGTAACTTCCCAGCATCTGGGAGATGCTGTCTCTTGCCTCACTGAGTGTTCC |
| | TTTTCTTTGCTCTCATGTCATTCCCTGAGAACAATGAATTCTGGGACAGGCTAAACATCATGATGAAGTTTCTTAAACAGACTTTC |
| | TTAGTGGAAATCCATTTAGATCTGGGTGTGCTCTATGGGGAGTGGTGACGTCAAAGAGCAAATGTCTATAAGGGGCCCTTTTAAAA |
| | TGAACATTTTCCTCATTGAGCAAGCTGGGATTCTCTAATGTAGAAATCAAGCCATCTTTATAATTTCACTTCAGATGTTTATGTTT |
| | TTGTTTTTTTTGTCTCCAATGATGGTAAAATAAAAACTACGCATTACTTAAAGGAGTTTCCCTCACATGTAAACACTGTTAGGAA |
| | GTCTGGATTAAGTTGAAAGTCCTGTTTTAACTTTTTTTCTCTCATATACCAAACACTCTGTATTTCTCTTAAAGAAGCCCTTTAAG |
| | AGAAAGCCCTAATTTTATATCTGACAGTAAAGTTTGCTGCAAGTGTATGATTTCAAACACATCCCTTGTTTTCTGTCCCTAGGGGA |
| | AAAGTCATGTAGTTTTAGCTTGGCTCCAGTGTTAATATTATATTCAGTAGCAGCCTTAGAAGAGTGGTCTAAGACTTGAACCTGGA |
| | GCAATTTTATAGCACAGAATCCTACGAAGATAGGACTGTGAACATTTGTTTTCTTTTCGTGTGTGTCAAACTAACTGGTTTTTGC |
| | TTTACCAATAAAATGTCCTCGGCAGAGTAAATTTTAAACGTGAAATTATAGATCTTGATATTGAATCCATCAGTGATTCAAGAGA |
| | TACACCTATTTGCCTAAAACAACCTAAGATGTATTGGTTATGGAATCATGTGTTGGATAGGTTCTTAAGACCTGTTTCCTCAAATC |
| | TTGACACAGTTTTCAAGGGTGGCTTATTGACTTGCACGGTTGGGCAGATAATTACCTAAGATTGGGTAAAAAGTCATC |
| | TGTGACTTTGCTGGCAGGGCATTTGCTAAGTGGAGTACAGGATCTAAAAGGGTTTTCTTAGAAAGGGCAATATTGTCCAATGAAGT |
| | AAGCAGAAGGACTCTGGGTTAGAAGCATCTGCACAAAACTGGTGAGACCTACTCTCCACTGCTCTGCAGCTGGATGGCTGATGGC |
| | AGGCTGAGCAGTGGGGAAGCAGGTTTTAACAACAGGGAGTCCTTCCAGGTCACTGTATATTGAGAAGAAACATAAAACTATTGTCT |
| | GTTACATTCCGAGGTCAGCCTTCTTCTTAACGTTTTATAAATATGCAAATGCCAGCTTCTGGAAAGCAAGTATCATCATGTACCAAA |
| | TGCTTTATACACCATCACATTCATGAATTTTTAGCATGGTCAGAACTTGTGTAAATATGTCTCTTAGATGATTTTGGGGAGATGT |
| | GATTTATTTTTCATATTTTCAAAATGCATTTCATTTCAAATAAAGTTATCTATTGAGACAACCGA |
| 39 | CGGCGGGCGGCGCGCACACTGCTCGCTGGGCCGCGGCTCCCGGGTGTCCCAGGCCCGGCCGGTGCGCAGAGCATGGCGGGTGCGGG |
| | CCCGAAGCGGCGCGCGCTAGCGGCGCCGGCGGCCGAGGAGAAGGAAGAGGCGCGGGAGAAGATGCTGGCCGCCAAGAGCGCGGACG |
| | GCTCGGCGCCGGCAGGCGAGGGCGAGGGCGTGACCCTGCAGCGGAACATCACGCTGCTCAACGGCGTGGCCATCATCGTGGGGACC |
| | ATTATCGGCTCGGGCATCTTCGTGACGCCCACGGGCGTGCTCAAGGAGGCAGGCTCGCCGGGGCTGGCGCTGGTGGTGTGGGCCGC |
| | GTGCGGCGTCTTCTCCATCGTGGGCGCGCTCTGCTACGCGGAGCTCGGCACCACCATCTCCAAATCGGGCGGCGACTACGCCTACA |
| | TGCTGGAGGTCTACGGCTCGCTGCCCGCCTTCCTCAAGCTCTGGATCGAGCTGCTCATCATCCGGCCTTCATCGCAGTACATCGTG |
| | GCCCTGGTCTTCGCCACCTACCTGCTCAAGCGCTCTTCCCACCTGCCCGGTGCCGAGGAGGCAGCCAAGCTCGTGGCCTGCCT |
| | CTGCGTGCTGCTGCTCACGGCCGTGAACTGCTACAGCGTGAAGGCCGCCACCCGGGTCCAGGATGCCTTTGCCGCCGCCAAGCTCC |
| | TGGCCCTGGCCCTGATCATCCTGCTGGGCTTCGTCCAGATCGGGAAGGGTGATGTGTCCAATCTAGATCCCAACTTCTCATTTGAA |
| | GGCACCAAACTGGATGTGGGGAACATTGTGCTGGCATTATACAGCGGCCTCTTTGCCTATGGAGGATGGAATTACTTGAATTTCGT |

TABLE 1-continued

Sequences Table. First column: SEQ ID No. Second column: corresponding mRNA sequence. For the 3 different groups, see explanation in the text.

CACAGAGGAAATGATCAACCCCTACAGAAACCTGCCCCTGGCCATCATCATCTCCCTGCCCATCGTGACGCTGGTGTACGTGCTGA
CCAACCTGGCCTACTTCACCACCCTGTCCACCGAGCAGATGCTGTCGTCCGAGGCCGTGGCCGTGGACTTCGGGAACTATCACCTG
GGCGTCATGTCCTGGATCATCCCCGTCTTCGTGGGCCTGTCCTGCTTCGGCTCCGTCAATGGGTCCCTGTTCACATCCTCCAGGCT
CTTCTTCGTGGGGTCCCGGGAAGGCCACCTGCCCTCCATCCTCCATGATCCACCTCACCACCAGCTCCTCACCCCCGTGCCGTCCTCG
TGTTCACGTGTGTGATGACGCTGCTCTACGCCTTCTCCAAGGACATCTTCTCCGTCATCAACTTCTTCAGCTTCTTCAACTGGCTC
TGCGTGGCCCTGGCCATCATCGGCATGATCTGGCTGCGCCACAGAAAGCCTGAGCTTGAGCGGCCCATCAAGGTGAACCTGGCCCT
GCCTGTGTTCTTCATCCTGGCCTGCCTCTTCCTGATCGCCGTCTCCTTCTGGAAGACACCCGTGGAGTGTGGCATCGGCTTCACCA
TCATCCTCAGCGGGCTGCCCGTCTACTTCTTCGGGGTCTGGTGGAAAACAAGCCCAAGTGGCTCCTCCAGGGCATCTTCTCCACG
ACCGTCCTGTGTCAGAAGCTCATGCAGGTGGTCCCCCAGGAGACATAGCCAGGAGGCCGAGTGGCTGCCGGAGGAGCATGCGCAGA
GGCCAGTTAAAGTAGATCACCTCCTCGAACCCACTCCGGTTCCCCGCAACCCACAGCTCAGCTGCCCATCCCAGTCCCTCGCCGTC
CCTCCCAGGTCGGCAGTGGAGGCTGCTGTGAAAACTCTGGTACGAATCTCATCCCTCAACTGAGGGCCAGGGACCCAGGTGTGCC
TGTGCTCCTGCCCAGGAGCAGCTTTTGGTCTCCTTGGGCCCTTTTCCCTTCCCTCCTTTGTTTACTTATATATATATTTTTTTA
AACTTAAATTTTGGGTCAACTTGACACCACTAAGATGATTTTTTAAGGAGCTGGGGGAAGGCAGGAGCCTTCCTTTCTCCTGCCCC
AAGGGCCCAGACCCTGGGCAAACAGAGCTACTGAGACTTGGAACCTCATTGCTACCACAGACTTGCACTGAAGCCGGACAGCTGCC
CAGACACATGGGCTTGTGACATTCGTGAAAACCAACCCTGTGGGCTTATGTCTCTGCCTTAGGGTTTGCAGAGTGGAAACTCAGCC
GTAGGGTGGCACTGGGAGGGGTGGGGGATCTGGGCAAGGTGGGTGATTCCTCCCAGGAGGTGCTTGAGGCCCCGATGGACTCCTG
ACCATAATCCTAGCCCCGAGACACCATCCTGAGCCAGGGAACAGCCCCAGGGTTGGGGGGTGCCGGCATCTCCCCTAGCTCACCAG
GCCTGGCCTCTGGGCAGTGTGGCCTCTTGGCTATTTCTGTGTCCAGTTTTGGAGGCTGAGTTCTGGTTCATGCAGACAAAGCCCTG
TCCTTCAGTCTTCTAGAAACAGAGACAAGAAAGGCAGACACACCGCGGCCAGGCACCCATGTGGGCGCCCACCCTGGGCTCCACAC
AGCAGTGTCCCCTGCCCCAGAGGTCGCAGCTACCCTCAGCCTCCAATGCATTGGCCTCTGTACCGCCCGGCAGCCCCTTCTGGCCG
GTGCTGGGTTCCCACTCCCGGCCTAGGCACCTCCCCGCTCTCCCTGCTCCTCATGTCCTGTCCTGGTCCTGATGCCCGTTGTCT
AGGAGACAGAGCCAAGCACTGCTCACGTCTCTGCCGCCTGCGTTTGGAGGCCCCTGGGCTCTCACCCAGTCCCCACCCGCCTGCAG
AGAGGGAACTAGGGCACCCCTTGTTTCTGTTGTTCCCGTGAATTTTTTTCGCTATGGGAGGCAGCCGAGGCCTGGCCAATGCGGCC
CACTTTCCTGAGCTGTCGCTGCCTCCATGGCAGCAGCCAGGGACCCCAGAACAAGAAGACCCCGCAGGATCCCTCCTGAGCTCGG
GGGGCTCTGCCTTCTCAGGCCCCGGGCTTCCCTTCTCCCCAGCCAGAGGTGGAGCCAAGTGGTCCAGCGTCACTCCAGTGCTCAGC
TGTGGCTGGAGGAGCTGGCCTGTGGCACAGCCCTGAGTGTCCCAAGCCGGGAGCCAACGAAGCCGGACACGGCTTCACTGACCAGC
GGCTGCTCAAGCCGCAAGCTCTCAGCAAGTGCCCAGTGGAGCCTGCCGCCCCCGCTGGGCACCGGGACCCCCTCACCATCCAGTG
GGCCCCGGAGAAACCTGATGAACAGTTTGGGGACTCAGGACCAGATGTCCGTCTCTCTTGCTTGAGGAATGAAGACCTTTATTCACC
CCTGCCCGTTGCTTCCCGCTGCACATGGACAGACTTCACGCGTCTGCTCATAGGACCTGCATCCTTCCTGGGGACGAATTCCAC
TCGTCCAAGGGACAGCCCACGGTCTGGAGGCCGAGGACCACCAGCAGGCAGGTGGACTGACTGTGTTGGGCAAGACCTCTTCCCTC
TGGGCCTGTTCTCTTGGCTGCAAATAAGGACAGCAGCTGGTGCCCCACCTGCCTGGTGCATTGCTGTGTGAATCCAGGAGGCAGTG
GACATCGTAGGCAGCCACGGCCCCGGGTCCAGGAGAAGTGCTCCCTGGAGGCACGCACCACTGCTTCCCACTGGGGCCGGCGGGGC
CCACGCACGACGTCAGCCTCTTACCTTCCCGCCTCGGCTAGGGGTCCTCGGGATGCCGTTCTGTTCCAACCTCCTGCTCTGGGACG
TGGACATGCCTCAAGGATACAGGGAGCCGGCGGCCTCTCGACAGCCACGCACTTGCCTGTTGGCTGCTGCGGCTGTGGGCGAGCATG
GGGGCTGCCAGCGTCTGTTGTGGAAAGTAGCTGCTAGTGAAATGGCTGGGGCCGCTGGGGTCCGTCTTCACACTGCGCAGGTCTCT
TCTGGGCGTCTGAGCTGGGGTGGGAGCTCCTCCGCAGAAGGTTGGTGGGGGGTCCAGTCTGTGATCCTTGGTGCTGTGTGCCCCAC
TCCAGCTGGGGACCCCACTTCAGAAGGTAGGGGCCGTGTCCCGCGGTGCTGACTGAGGCCTGCTTCCCCCTCCCCCTCCTGCTGT
GCTGGAATTCCACAGGGACCCAGGGCCACCGCAGGGGACTGTCTCAGAAGACTTGATTTTTCCGTCCCTTTTTCTCCACACTCCACT
GACAAACGTCCCCAGCGGTTTCCACTTGTGGGCTTCAGGTGTTTTCAAGCACAACCCACCACAACAAGCAAGTGCATTTTCAGTCG
TTGTGCTTTTTTGTTTTGTGCTAACGTCTTACTAATTTAAAGATGCTGTCGGCACCATGTTTATTTATTTCCAGTGGTCATGCTCA
GCCTTGCTGCTCTGCGTGGCGCAGGTGCCATGCCTGCTCCCTGTCTGTGTCCCAGCCACGCAGGGCCATCCACTGTGACGTCGGCC
GACCAGGCTGGACACCCTCTGCCGAGTAATGACGTGTGTGGCTGGGACCTTCTTTATTCTGTGTTAATGGCTAACCTGTTACACTG
GGCTGGGTTGGGTAGGGTGTTCTGGCTTTTTTGTGGGGTTTTTATTTTTAAAGAAACACTCAATCATCCTA

40  ACATACTTTTGAAGGATGTGCAACGTTCAATGATAAGTGTGACAAAAACTGACAACCAGGAAGCTTGTGTACTCAGTGAGAGTAGC
ATGTTTGTCTCCAAGAAACGTTTCATTTTGAAGACACGTGGTACCACTCTCTTACTGAAAGCGCTGGTTCCCCTGTTGAAGCTTGC
TAGGCATTACAGTGGGTTTGACTCAATTCAAAGCTTCTTTTATTCTTGTGAGAATTTCATGAAGCCTTCCCCCTAAGGGTACCTAC
ACTAGAATTTCCAGGAAGAAATAGAGTTTCTTAATGCAATTTTCCCAAATGGAGCAGCATATTGTATGGGAAGTATGAATTCTGAC
TGTTGGTACTTACGTACTCTGGATTTCCCAGAAAGGTAATCAGTCAGCCAGATCAAACCCTGGAAAATTTGATGAGTGGGCTTGAC
CCAGCAGTTTATGGACCAGTTCTACATGAAAGATGGCGTTACTGCAAAGGATGTCATTTGTGAGAGTGGAATTCACAACCTGATACC
AGGTTCTGTCATTAATGCCACAATGTTCAATCCTTATGGGTATTCGATGAATGGAATGAAATCAGATGGAACTTATTGGACTATTC
ACATCACTCCAGAACCAGAATCTTTTTATGTTAGCTTTGAAACAAACTTAAGCCACCTTCCTATGATGACCTGATCAGGAAAGCTAT
GGAAGGCTTCAAGCCAGGAAAATTTGTGATCACTTTGTTAATCAGAGTTCTAAATGTCGCGCCGTGTTTTCTTCACCTCAGAAGAT
TGAAGGTTTTAAGCGTCTTGATTGCCAGAGTGCTATGTTCAATGATCATTTGTTTTTACCAGTTTTGCTAAGAAGCAGCAAT
AACAGCAGAGTTGATTAAGAAAAATGAAGAAAAAATGCAAAAAGAGAACACACGTAAGAAGGTGGTGGATGCTTTCTAGATGTCG
ATGCTGGGGTCAGTGCTTTCCATAACCACCACAGTGTAGTTGCATAAAGCCCTATATGTAATGATAGTGTAATCATTTTGAATTGT
ATGCATTATTATATCAAGGAAATAGATATCTTGCACGAATGTTCGCTTCTGTGTTTAGGTATTCTCTGCCACTCTTGCTGTGAAAT
TGAAGTGCATGTAGAAAAAACCTTTTACTATATGAAACTTTATAACACTTGTGAAAGCAATTCAATTTGGTTTATGCACAGTGTAA
TATTTCTCCAAGTATCATCCAAAATTCCCCACAGACAAAGCTTTCATCCTCATTAGGTGTTGGACTCAGCCTAACCGTCTAGGACT
GTTCTATTAAATTGCTGCCAGAATTTTACATCCAGTTACCTCCACTTTCTAGAACATATTCTTTACTAATATTATTGAAACCAATT
TCTACCTCATACAGAGGTTTTTTAAAACAGCAATTAAAGTTTTTCTTCCATGAAAAAAAAAAAAA

41  CTTTCCCGAGTCCGTTTGAGGAAGTCCCCGAGGCGCACAGAGCAAGCCCACGCGAGGGCACCTCTGGAGGGGAGCGCCTGCAGGAC
CTTGTAAAGTCAAAAATGTCAGAAACTTCCAGGACCGCCTTTGGAGGCAGAAGAGCAGTTCCACCCAATAACTCTAATGCAGCGGA
AGATGACCTGCCCACAGTGGAGCTTCAGGGCGTGGTGCCCCGGGGCGTCAACCTGCAAGAGTTTCTTAATGTCACGAGCGTTCACC
TGTTCAAGGAGAGATGGGACACTAACAAGGTGGACCACCACACTGACAAGTATGAAAACAACAAGCTGATTGTCCGCAGAGGGCAG
TCTTTCTATGTGCAGATTGACTTCCAGCGTCATATGACCCCAGAAGGGATCTCTTCAGGGTGGAATACGTCATTGGTCGCTACCC
ACAGGAGAACAAGGGAACCTACATCCCAGTGCCTATAGTCCTCAGAGTTACAAAGTGGAAAGTGGGGGCCAAGATTGTCATGAGAG
AGGACAGGTCTGTGCGGCTGTCCATCCAGTCTTCCCCCAAATGTATTGTGGGGAAATTCCGCATGTATGTTGCTGTCTGGACTCCC
TATGGCGTACTTCGAACCAGTCGAAACCCAGAAACAGACACGTACATTCTCTTCAATCCTTGGTGTGAAGATGATGCTGTGTATCT
GGACAATGAGAAAGAAGAGGATATTCCTGAATGACATGGGAGGGGTAATTTTTTATGGAGAGGTCAATGACATCAAGACCAGAA
GCTGGAGCTATGGTCAGTTTGAAGATGGCATCCTGGACACTTGCCTGTATGTGATGGACAGAGACAAATGGACCTCTCTGGAAGA
GGGAATCCCATCAAAGTCAGCCGTGTGGGGTCTGCAATGGTGAATGCCAAAGATGACGAAGGTGTCCTCGTTGGATCCTGGGACAA
TATCTATGCCTATGGCGTCCCCCCATCGGCCTGGACTGGAAGCGTTGACATTCTATTGGAATACCGGAGCTCTGAGAATCCAGTCC
GGTATGGCCAATGCTGGGTTTTTGCTGGTGTCTTTAACACATTTTTACGATGCCTTGGAATACCAGCAAGAATTGTTACCAATTAT
TTCTCTGCCCATGATAATGATGCCAATTTGCAAATGGACATCTTCCTGGAAGAAGATGGGAACGTGAATTCCAAACTCACCAAGGA

TABLE 1-continued

Sequences Table. First column: SEQ ID No. Second column: corresponding mRNA sequence. For the 3 different groups, see explanation in the text.

```
   TTCAGTGTGGAACTACCACTGCTGGAATGAAGCATGGATGACAAGGCCTGACCTTCCTGTTGGATTTGGAGGCTGGCAAGCTGTGG
   ACAGCACCCCCAGGAAAATAGCGATGGCATGTATCGGTGTGGCCCCGCCTCGGTTCAAGCCATCAAGCACGGCCATGTCTGCTTC
   CAATTTGATGCACCTTTTGTTTTTGCAGAGGTCAACAGCGACCTCATTTACATTACAGCTAAGAAAGATGGCACTCATGTGGTGGA
   AAATGTGGATGCCACCCACATTGGGAAATTAATTGTGACCAACAAATTGGAGGAGATGGCATGATGGATATTACTGATACTTACA
   AATTCCAAGAAGGTCAAGAAGAAGAGAGATTGGCCCTAGAAACTGCCCTGATGTACGGAGCTAAAAAGCCCCTCAACACAGAAGGT
   GTCATGAAATCAAGGTCCAACGTTGACATGGACTTTGAAGTGGAAAATGCTGTGCTGGGAAAAGACTTCAAGCTCTCCATCACCTT
   CCGGAACAACAGCCACAACCGTTACACCATCACAGCTTATCTCTCAGCCAACATCACCTTCTACACCGGGGTCCCGAAGGCAGAGT
   TCAAGAAGGAGACGTTCGACGTGACGCTGGAGCCCTTGTCCTTCAAGAAAGAGGCGGTGCTGATCCAAGCCGGCGAGTACATGGGT
   CAGCTGCTGGAACAAGCGTCCCTGCACTTCTTTGTCACAGCTCGCATCAATGAGACCAGGGATGTTCTGGCCAAGCAAAAGTCCAC
   CGTGCTAACCATCCCTGAGATCATCATCAAGGTCCGTGGCACTCAGGTAGTTGGTTCTGACATGACTGTGACAGTTCAGTTTACCA
   ATCCTTTAAAAGAAACCCTGCGAAATGTCTGGGTACACCTGGATGGTCCTGGAGTAACAAGACCAATGAAGAAGATGTTCCGTGAA
   ATCCGGCCCAACTCCACCGTGCAGTGGGAAGAAGTGTGCCGGCCCTGGGTCTCTGGGCATCGGAAGCTGATAGCCAGCATGAGCAG
   TGACTCCCTGAGACATGTGTATGGCGAGCTGGACGTGCAGATTCAAGATGGACCTTCCATGTGAATGCACAGGAAGCTGAGATGAA
   CCCTGGCATTTGGCCTCTTGTAGTCTTGGCTAAGGAAATTCTAACGCAAAAATAGCTCTTGCTTTGACTTAGGTGTGAAGACCCAG
   ACAGGACTGCAGAGGGCCCCAGAGTGGAGATCCCACATATTTCAAAACATACTTTTCAAACCCAGGCTATTCGGCAAGGAAGTT
   AGTTTTTAATCTCTCCACCTTCCAAAGAGTGCTAAGCATTAGCTTTAATTAAGCTCTCATAGCTCATAAGAGTAACAGTCATCATT
   TATCATCACAAATGGCTACATCTCCAAATATCAGTGGGCTCTCTTACAGGGAGATTTGCTCAATACCTGGCCTCATTTAAAACAA
   GACTTCAGATTCCCCACTCAGCCTTTTGGGAATAATAGCACATGATTTGGGCTCTAGAATTCCAGTCCCCTTTCTCGGGGTCAGGT
   TCTACCCTCCATGTGAGAATATTTTTCCCAGGACTAGAGCACAACATAATTTTATTTTGGCAAAGCCAGAAAAAGATCTTTCAT
   TTTGCACCTGCAGCCAAGCAAATGCCTGCCAAATTTTAGATTTACCTTGTTAGAAGAGGTGGCCCCATATTAACAAATTGCATTTG
   TGGGAAACTTAACCACCTACAAGGAGATAAGAAAGCAGGTGCAACACTCAAGTCTATTGAATAATGTAGTTTTGTGATGCATTTTA
   TAGAATGTGTCACACTGTGGCCTGATCAGCAGGAGCCAATATCCCTTACTTTAACCCTTTCTGGGATGCAATACTAGGAAGTAAAG
   TGAAGAATTTATCTCTTTAGTTAGTGATTATATTTCACCCATCTCTCAGGAATCATCTCCTTTGCAGAATGATGCAGGTTCAGGTC
   CCCTTTCAGAGATATAATAAGCCCAACAAGTTGAAGAAGCTGGCGGATCTAGTGACCAGATATATAGAAGGACTGCAGCCACTGAT
   TCTCTCTTGTCCTTCACATCACCATTTTGAGACCTCAGCTTGGCACTCAGGTGCTGAAGGGTAATATGGACTCAGCCTTGCAAATA
   GCCAGTGCTAGTTCTGACCCAACCACAGAGGATGCTGACATCATTTGTATTATGTTCCAAGGCTACTACAGAGAAGGCTGCCTGCT
   ATGTATTTGCAAGGCTGATTTATGGTCAGAATTTCCCTCTGATATGTCTAGGGTGTGATTTAGGTCAGTAGACTGTGATTCTTAGC
   AAAAAATGAACAGTGATAAGTATACTGGGGGCAAAATCAGAATGGAATGCTCTGGTCTATATAACCACATTTCTGAGCCTTTGAGA
   CTGTTCCTGAGCCTTCAGCACTAACCTATGAGGGTGAGCTGGTCCCCTCTATATATACATCATACTTAACTTTACTAAGTAATCTC
   ACAGCATTTGCCAAGTCTCCCAATATCCAATTTTAAAATGAAATGCATTTTGCTAGACAGTTAAACTGGCTTAACTTAGTATATTA
   TTATTAATTACAATGTAATAGAAGCTTAAAATAAAGTTAAACTGATTAT

42 AGCTATTTCAAGGCGCGCGCCTCGTGGTGGACTCACCGCTAGCCCGCAGCGCTCGGCTTCCTGGTAATTCTTCACCTCTTTTCTCA
   GCTCCCTGCAGCATGGGTGCTGGGCCTCCTTGCTGCTCGCCGCCCTCCTGCTGCTTCTCTCCGGCGACGGCGCCGTGCGCTGCGA
   CACACCTGCCAACTGCACCTATCTTGACCTGCTGGGCACCTGGGTCTTCCAGGTGGGCTCCAGCGGTTCCCAGCGCGATGTCAACT
   GCTCGGTTATGGGACCACAAGAAAAAAAGTAGTGGTGTACCTTCAGAAGCTGGATACAGCATATGATGACCTTGGCAATTCTGGC
   CATTTCACCATCATTTACAACCAAGGCTTTGAGATTGTGTTGAATGACTACAAGTGGGTTTGCCTTTTTTAAGTATAAAGAAGAGGG
   CAGCAAGGTGACCACTTACTGCAACGAGACAATGACTGGGTGGGTGCATGATGTGTTGGGCCGGACTCGGCTTGTTTCACCGGAA
   AGAAGGTGGGAACTGCCTCTGAGAATGTGTATGTCAACACAGCACACCTTAAGAATTCTCAGGAAAAGTATTCTAATAGGCTCTAC
   AAGTATGATCACAACTTTGTGAAAGCTATCAATGCCATTCAGAAGTCTTGGACTGCAACTACATACATGGAATATGAGACTCTTAC
   CCTGGGAGATATGATTAGGAGAAGTGGTGGCCACAGTCGAAAAATCCCAAGGCCCAAACCTGCACCACTGACTGCTGAAATACAGC
   AAAAGATTTTGCATTTGCCAACATCTTGGGACTGGAGAAATGTTCATGGTATCAATTTTGTCAGTCCTGTTCGAACCAAGCATCC
   TGTGGCAGCTGCTACTCATTTGCTTCTATGGGTATGCTAGAAGCGAGAATCCGTATACTAACCAACAATTCTCAGACCCCAATCCT
   AAGCCCTCAGGAGGTTGTGTCTTGTAGCCAGTATGCTCAAGGCTGTGAAGGCGGCTTCCCATACCTTATTGCAGGAAAGTACGCCC
   AAGATTTTGGGCTGGTGGAAGAAGCTTGCTTCCCCTACACAGGCACTGATTCTCCATGCAAAATGAAGGAAGACTGCTTTCGTTAT
   TACTCCTCTGAGTACCACTATGTAGGGAGGTTTCTATGGAGGCTGCAATGAAGCCCTGATGAAGCTTGAGTTGGTCCATCATGGGCC
   CATGGCAGTTGCTTTTGAAGTATATGATGACTTCCTCCACTACAAAAGGGGATCTACCACCACACTGGTCTAAGAGACCCTTTCA
   ACCCCTTTGAGCTGACTAATCATGCTGTTCTGCTTGTGGGCTATGGCACTGACTCAGCCTCTGGGATGGATTACTGGATTGTTAAA
   AACAGCTGGGGCACCGGCTGGGGTGAGAATGGCTACTTCCGGATCCGCAGAGGAACTGATGAGTGTGCAATTGAGAGCATAGCAGT
   GGCAGCCACACCAATTCCTAAATTGTAGGGTATGCCTTCCAGTATTTCATAATGATCTGCATCAGTTGTAAAGGGGAATTGGTATA
   TTCACAGACTGTAGACTTTCAGCAGCAATCTCAGAAGCTTACAAATAGATTTCCATGAAGATATTTGTCTTCAGAATTAAAACTGC
   CCTTAATTTTAATATACCTTTCAATCGGCCACTGGCCATTTTTTTCTAAGTATTCAATTAAGTGGGAATTTTCTGGAAGATGGTCA
   GCTATGAAGTAATAGAGTTTGCTTAATCATTTGTAATTCAAACATGCTATATTTTTAAAATCAATGTGAAAACATAGACTTATTT
   TTAAATTGTACCAATCACAAGAAAATAATGGCAATAATTATCAAAACTTTTAAAATAGATGCTCATATTTTTAAAATAAAGTTTTA
   AAAATAACTGCA

43 GCCCTGCGCACTCCCTGCTGGGGTGAGCAGCACTGTAAAGATGAAGCTGGCTAACTGGTACTGGCTGAGCTCAGCTGTTCTTGCCA
   CTTACGGTTTTTGGTTGTGGCAAACAATGAAACAGAGGAAATTAAAGATGAAAGAGCAAAGGATGTCTGCCCAGTGAGACTAGAA
   AGCAGAGGGAAATGCGAAGAGGCAGGGGAGTGCCCCTACCAGGTAAGCCTGCCCCCCTTGACTATTCAGCTCCCGAAGCAATTCA
   CAGGATCGAGGAGGTGTTCAAAGAAGTCCAAAACCTCAAGGAAATCGTAAATAGTCTAAAGAAATCTTGCCAAGACTGCAAGCTGC
   AGGCTGATGACAACGGAGACCCAGGCAGAAACGGACTGTTGTTACCCAGTACAGGAGCCCCGGGAGAGGTTGGTGATAACAGAGTT
   AGAGAATTAGAGAGTGAGGTTAACAAGCTGTCCTCTGAGCTAAAGAATGCCAAAGAGGAGATCAATGTACTTCATGGTCGCCTGGA
   GAAGCTGAATCTTGTAAATATGAACAACATAGAAAATTATGTTGACAAGCAAAGTGGCAAATCTAACATTTGTTGTCAATAGTTTGG
   ATGGCAAATGTTCAAAGTGTCCCAGCCAAGAACAAATACAGTCACGTCCAGTTCAACATCTAATATATAAAGATTGCTCTGACTAC
   TACGCAATAGGCAAAAGAAGCAGTGAGACCTACAGAGTTACACCTGATCCCAAAAATAGTAGCTTTGAAGTTTACTGTGACATGGA
   GACCATGGGGGGAGGCTGGACAGTGCTGCAGGCACGTCTCGATGGGAGCACCAACTTCACCAGAACATGGCAAGACTACAAAGCAG
   GCTTTGGAAACCTCAGAGGGAATTTTGGCTGGGGAACGATAAAATTCATCTTCTGACCAAGAGTAAGGAAATTGATTCTGAGAATA
   GATCTTGAAGACTTTAATGGTGTCGAACTATATGCCTTGTATGATCAGTTTTATGGCTAATGAGTTTCTCAAATATCGTTTACA
   CGTTGGTAACTATAATGGCACAGCTGGAGATGCATTACGTTTCAACAAACATTACAACCACGATCTGAAGTTTTTCACCACTCCAG
   ATAAAGACAATGATCGATATCCTTCTGGGAACTGTGGGCTGTACTACAGTTCAGGCTGGTGGTTTGATGCATGTCTTTCTGCAAAC
   TTAAATGGCAAATATTATCACCAAAAATACAGAGGTGTCCGTAATGTCAATGCCATCTGGCCTGGTATTAAGTGGAAGCCACA
   CCCTGGTGGCTACAAGTCCTCCTTCAAAGAGGCTAAGATGATGATCAGACCCAAGCACTTTAAGCCATAAATCACTCTGTTCATTC
   CTCCAGGTATTCGTTATCTAATAGGGCAATTAATTCCTTCAGCACTTTAGAATATGCCTTGTTTCATATTTTTCATAGCTAAAAAA
   TGATGTCTGACGGCTAGGTTCTTATGCTACACAGCATTTGAAATAAAGCTGAAAACAATGCATTTTAAAGGAGTCCTTTGTTGTT
   ATGCTGTTATCCAATGAACACTTGCAAGCAATTAGCAATATTGAGAATTACATTAGATTTACAATTCTTTTAATTTCTATTGAA
   ACTTTTTCTATTGCTTGTATTACTTGCTGTATTTAAAAAATAATTGTTGGCTGGGTGTGGTAGCTCACGCCTGTAATCCCAGCACT
```

TABLE 1-continued

Sequences Table. First column: SEQ ID No. Second column: corresponding mRNA sequence. For the 3 different groups, see explanation in the text.

```
   TTGGAATGTCAAGGCAGGCAGATCACTTGAGGTCAGGAGTTTGAGACCAGCCTGGCCAAACATGTGAAACGCTGTCTCTATTAAAA
   ATACAAAAATTAGCCGGGCATGGTGGTACATGCCTGTAATCCTAGCTACTTGGGAGGCTGAGGCAGGAGAATCGCTTGAACCTGAG
   AGGAAGAGGTTGCAGTGAGCCAAGACTGAGCCACTGCACTCCAGCATGGGTGACAGAGAAAACTCTGTCTCAAACAAAAAAATAAT
   AAAATTTATTCAGTAGGCTGGATTCTACACAAAGTAATCTGTATTTGGGCCATGATTTAAGCACATCTGAAGGTATATCACTCTTT
   TCAGGCTATAATTATTTGGGTAATCTTCATTCTGAGACAAACTTAATCTATATCATTTACTTTGCAACAGAACAACCCTACAGCAT
   TTTGGTTCCCAGACTAAGGGAACTAATATCTATATAATTAAACTTGTTCATTTATCATTCATGAAATATAAAATACTTGTCATTTA
   AACCGTTTAAAAATGTGGTAGCATAATGTCACCCCAAAAAGCATTCAGAAAGCAATGTAACTGTGAAGACCAGGGTTTAAAGGTAA
   TTCATTTATAGTTTATAACTCCTTAGATGTTTGATGTTGAAAACTGCTTTAACATGAAAATTATCTTCCTCTGCTCTGTGTGAACA
   ATAGCTTTTAATTTAAGATTGCTCACTACTGTACTAGACTACTGGTAGGTTTTTTTGGGGGGGTGGGTAGGGATATGTGGGTAAT
   GAAGCATTTACTTACAGGCTATCATACTCTGAGGCCAATTTTATCTCCAAAGCAATAATATCATTAAGTGATTCACTTCATAGAAG
   GCTAAGTTTCTCTAGGACAGATAGAAAACATGAATTTTGAAATATATAGAACAGTAGTTAAAATACTATATATTTCAACCCTGGCT
   GGTAGATTGCTTATTTTACTATCAGAAACTAAAAGATAGATTTTTACCCAAACAGAAGTATCTGTAATTTTTATAATTCATCAATT
   CTGGAATGCTATATATAATATTTAAAAGACTTTTTAAATGTGTTTAATTTCATCATCGTAAAAAGGGATCATCTCAGAGAGAACAG
   CAGTATTCTGCGTATTTTTAAAAATGCTCTAGAGTAACATTTGAAGTAATTCACTGTAGTGTATGCCAGTCCTAGAAATAATTTTT
   TTAATTTCTGGTGTCTGTTTCTAATACACTAACCAAGTTTTCAAATATATTTACAAAGATGCATCTTTACCCATTATTTTAAAT
   GATTAAGGAGGATAGTTGCTTCAGGTAACAAGCTAATTTTTCAAATATTAGGCCCTTACAGAACTATTTAGTCAAAAGTAAGATA
   TTCCTTTAAAATATATAACCCAAAGCTTTCAGTTAAACATGATATATACAGAGTTCGTATGCTTTAAAGAGAAATGCAAATAG
   CATTAAATGATGACCAAAATGTAAAATATTGTAGATTTCAAAAGCTGTGTCTCTATTAGGTGGGATACCAAATGTAAATGATGTAA
   CTGACGTTGTTTTTACTTTTTACTTTTTAAAAAGACTAAAACGTTTTGATATTATCAATGTATTTGTTTCAGATAAGGTCAT
   TGTCATTTAGTATATATAATTAATATATGTACAAGTTTAAGTAAATTCCTGTGAGTAAAAATGGACTTATCACAAAACATAGTTCT
   AAAGAAAGGTATATGCTCATATACACGGTGTCCATTAATTTAATGGGAACTAGGTATAACTTCAGGAGAATTTGGCAAATAATTCA
   TTAATCCATGTAAATATTCAAAAGCTTGTTCTATCCACATTATTTCAAGGGATCACTTTATTTTTCATTATACTTTCACAGCACTT
   TTCTAGTAAATTCTGTAACACAGAAATTCCATTTTGGAATCATTTCATGTTACCAATAATTCTAGACTTTTATAACATTTAACATG
   TTGATGGAAATAGATTACATCTGCTAGAACCTTTTGCCTTAACTATTCACCAATATATGCTAATATTCATAAATATGGATTGACTG
   TTTACAAACATTAGAATCTTGTCTTGGTTCCATTTTGATGGCTAATATTTGTTATCTTAATTAAGACTATTTCTGAGGTCATGATT
   ACTTGAAAATATTGACTAAAACTGGGTCCTTAGAAATTCCAGGTGGAGCTGATTTACCTATGACTGAGGGGAAAAAAAAATCAAAT
   TTTACTGATAATAGTAATGCTCCAAATGAATTAATGACACATCTGTTCAATAAATAAAGAGCTTAAATATACAAACATAAGAAAT
   CTGGGCAACAAACTTGTGGTCTTTACTTTTGAATAGCTACCCAAGAAAAGGTTTTAAAGGTAAAAGTTATGAGTAATGTCATCAC
   AATAAGCTCTTGTTTAAAATTCTTTTCTTTTATGTATAATTAGGTTTATGTTTCATGTCTTTTTAAAACCTTATAAAAGATTTAAT
   TATCACATCTATTCTTCAATGTGGAAATATTAAATATTGTTGGTTGTAAAATAA

44 GTTTAAGTAGAATCCTCAAGCTTGGCCTCAGAGTACTATGAGGCTTCTGAATCCAGGAATAAGACTGCTCTTGGATTTACTCTCTT
   TGTATTGCATGTCAAAGGCAACAGAACTGGACCAAGAAAATTCATAACTTTTTGTTTGTTTCTACTAAGATGACATCATACATGGC
   TATTGATGGCAGTGCTCTTGTTCCCTTGCGTCAGAAGCCCAGGAGGAAAACTCAAGGTTTTCTCACGATGAGTCGGAGGAGGATAT
   CGTGTAAAGATCTGGGCCATGCTGACTGCCAAGGGTGGCTGTATAGAAAAAGGAAAAGGGAAGTTTCCTAAGCAACAAATGGAAA
   AAGTTCTGGGTGATACTGAAGGGGTCGTCACTGTACTGGTATAGCAATCAAATGCAGAGAAAGCTGATGGATTTGTCAACCTGCC
   TGATTTCACTGTGGAAAGAGCATCTGAATGCAAGAAAAAGCATGCTTTTAAGATCAGCCATCCACAGATCAAGACCTTTTATTTTG
   CAGCTGAGAATGTGCAGAAGATGAACGTGTGGTTAAATAAACTTGGATCGGCTGTAATCCATCAGGAATCCACTACAAAGGATGAA
   GAATGTTACAGTGAAAGTGAACAGGAAGATCCAGAAATAGCTGCGGAGACACCACCCCCTCCTCACGCTTCCCAGACTCAGTCTTT
   GACTGCACAGCAGGCATCTTCATCCTCACCCAGCCTGAGTGGAACGTCGTATTCTTTCTCTTCCCTGGAAAATACAGTGAAGACAC
   CCAGCAGTTTTCCTTCCTCCTTATCTAAAGAGAGACAATCCTTGCCTGACACAGTTAACAGTTTGTCTGCTGCTGAAGATGAGGGA
   CAACCAATAACGTTTGCTGTGCAAGTTCATTCACCTGTACCCTCAGAGGCAGGCATCCACAAGGCCCTGGAAAACATGTTTGTCAC
   ATCAGAAAGTGGATTTTTGAACTCTTTTATCTAGTGATGATACTTCTTCATTGAGTAGCAATCATGACCATCTTACTGTCCCAGATA
   AGCCTGCTGGATCAAAGATCATGGACAAAGAAGAGACAAAGTGTCTGAAGATGATGAAATGGAGAAGCTGTACAAATCATTAGAG
   CAAGCTAGTCTATCTCCTCTTGGGGACCGACGACCTTCGACTAAAAAGGAGTTGAGAAAATCCTTTGTTAAGCGGTGTAAAAATCC
   ATCTATAAACGAGAAACTCCACAAAATCCGAACATTGAATAGCACATTAAAGTGTAAAGAACATGATCTGGCCATGATTAACCAGT
   TGCTGGATGACCCGAAGCTGACAGCCAGGAAATACAGAGAGTGGAAAGTCATGAACACCCTGCTGATCCAGGACATCTATCAGCAG
   CAGCGGGCTTCGCCTGCCCCTGATGACACTGATGACACCCCCAGGAACTCAAGAATCACCTTCTTCTCCCTCTGTTGAAATTC
   CATTTGAGACAAAGTCAGGGTTTTCTCCTCTTATATTTTATCACAAGCAACTCTTCAAGATGTTGCAAAAGCTTACATTTTTCCTT
   AAAAGGAAACTGAAACCCAGTCCTTCAAGCATCAGCTTCCCATCTAAAGATGCACGTTAGATGAAGATAATCACCGAATACACCA
   GGGCTCCTCATTTCAGTCGTAACGCATCCATTGAGATTGGAATGATTGAGTTCAGTTGAAAGGCGTTTTTTGTGTTCCTACTGGGA
   GCTCACGGTGATGTGGGGCTCTAGGGGGATGTGAGAAATGTCTCTTCTGTTCATTGCTCTCCAGAGAATGCTATGGACAAGAATC
   AAATTTTACCAGGAGTAATTGCCCATGGAAACATTCTGTTTTTCAAAGAAGAATGTACATATTCCACTTGACTGGGAAGCTGTGT
   GGCCCAAATCACTGTTTGAGTGGGAGGAATGTTTTCTAGAGCATGTTGACTGGAAGGACAAACGTGGTGTTCGAGAACAAAAATTCCTT
   GCCTTTGGTATGGAATGGTGGTGCCTTTTCCATGTGATGAGAAATGCTTCATAGACAGTGGCATGTGGGAGAGCTGAAGGAGGAGG
   CGTGTTCCATATTCCACTCATTCAAAGGACAGCTTGGTGTTTTCACACTTTATGCAGGTTAGGGGATCTGATTAATGTTTCCTTTC
   CTTACAACAGCTAGAGAAACATCTCATCACAATTGGAGACCTCTACTTCCTTTGAGCTTTCCTACTCAATGGTAGGAGATAGGAA
   TATGTTCCGCAAAGAATGTCTACTGCTCTTGTCCTTGGCTGTGATCCCTATACATAGTGTGAATTTATATCCAGGTTTCCCAGGAT
   CAATATTGACAAGACGACTTTGGCATCTGAATTGTTTTAATATCTTTACTCAAAAAACAAAAAACAAAAACCCATGGAAGCAAC
   AAAAGAGTTAAACATGAGGGATTTATTTTGTATGTTTATATGTCACTTGTGTGCTATGTGAATAGCTATGTTTGTTATTTAAATA
   TATTTATAGAAGTTCAAATTACTAGTGTTTAAAAGATGATATACTATTATATATTGTGCTTAGTATATATTTGATGAGTCTATACT
   TTTTGCTTGAGAAAAATAGAAATACTATTGATTCACTGGTGTTATGATGTTGCACTGTGTCTGAGGAATGCTCAGGAAATCTTGTG
   GGAAAAAAATGGGGCATGCATTCATAATTTTCATTTTCTTCCCCACCCCAACCCCCATGAGCTCTTAAATTTAGATTTCTATCTC
   TTGTAAGTCACTCTTTTAACCAGCAAAGGACTTTCATCTTAGATTATCCTTCTATTAAATAAACTTTAAGCTTTGTGCCATTTAT
   GCCTGCAAACCTTAGACCAAAGGCAACACAACTAATGTCATCTTTTCATTAAAGACTAATAGAAATTTAGAAATCATTGTGTTAAA
   GAGAGCTATAGAGAAACAATATGAAAGTCTTCCCTTACTAATCACCATGAATATTTCTCACCATAGGAATAACCACAACCCACCAA
   GTACCCATGTTGGCCCTGCCTACCCGTAACAAATTGTTCACACAACTCTATTTTGTTTTATAGCTTCAAAGTGTGGTTGCATTCA
   AAATGGAAGGAACCACCTGAATTATATCTGCAAACAAAATGGAAATAGTTGTTGAATAGTTCCCCAAGCTTTACTAAGAAGCCTTA
   ATACTCTGTAAACAAACAAACAAACAAAAAACAACCTTAGCATTAAGAAATAAAAACAAAAAACAAGAAGCAAGTTGTACTGCTAG
   AAACTTCTCTAAGATAAGAGGCCAGGCCAGTCAGTTTGGCCCAGCAAACATGTGGGTACTTCTCCACCTAGGGAAGCCACTGAAGA
   TGAGTTTGACCTGTGGTGACCTGACAGAGAGAACATTCAGATCCTCAGATTGCACCCTGATGCCCTGGTTTAGGAAAGCAGTGCTT
   TAACCTTTTGCCCCTGGAAATTACTGATTCTTTCTGTGATTAGCAGATACCAGAGGGAATTTATTTAGGATTGGCAATGTAAAGA
   GTATTGAAGGAACAACAAATAACAATAGCAGAAATAACAGTGTGACATAAAGTGCCCTTCCACCTATTTTCTTTGGTTTGCAACA
   CCAGCCTGTAGACTTCCAGTTTTTCTTAAATTGAAGAGCTCCAGACACTTTTGAGCAGGGTTTGTGAATAGCTTTGAATGCTTTCC
   TTTGGCTTTTCGTGAAGACATATTTCCCCAGCCTTTCAACTGTAAACTCCTTTAGTACCATTGAAACTTAAGGCAAAAAAGATCCC
   TGGGATTACTTAGCCAAGGCTTAAATTTATTTTTCAAAGTCAAGAACATTAGCCTAGAAGTTTTTGCTTTGCTAGTTAAAGCTTAC
```

TABLE 1-continued

Sequences Table. First column: SEQ ID No. Second column: corresponding mRNA sequence. For the 3 different groups, see explanation in the text.

|    |    |
|----|----|
|    | TTTGCAGAGCTTCCCAAAGTGAAAGGGAAACTGAACTTCACAATTTTGCACCTGGCTTTCTGGAGCCCCATTGCCTGCTCATTCGT<br>GTTTTTCCCCCTGTAAATTATTTTGCTTTTGACCAGGTTGTGCTAGAAAGTAGGGCTGCTTCTGTGAGTTCTCAGCCTAGGCTGTG<br>GCCACTAAGACGTGGGTGGGGGGATAGACAGGAGTGAGAGGGAGAGTGGGTGACACTTTCCGTGACACTTAATGTAGGAAGACATG<br>GGCTTCTCTCTCTTGGCCTCAAGCCACTTTTCTGGTCCAAAGAATATTGGGAAAACTGGATTACTTTCAGTATATTTCTTGAGACC<br>GGGTCATCTCTGAAATGCATTTGGGGTAGTTTCCTGGGGTCCAAGGGCCAATTCCTATACCCAGTCCTGCAGTGTCTGTGAGCTGT<br>GGAATGAGAGAGAAACCATGGCTGCTCAGGAAGGAAGTGGAGAATCTCTCAGCACACGTAGATCCAAATCTGTGGCACCTGCTAA<br>AGATTAGGATTTGGAGAGGACTCCTCTTTGGGGTTGTGAAGAGGACCTTTTCCCTCTGTTGTTAGCCTGTAGATCCAGAACGGAGC<br>CTGATGTGATGCCTTCACTGGTTGATATATTGCAAATAGACACTCTGAGCCCTGCATTGCAAGGGCGTCTTTTGCTTTAAAGAATT<br>CTTAGTTTTGCCACAACAGCTCAAATCTCAGAATAGGATCAAAGGCCTAGAAAGACTCCTAAAGTATAGGATTACAAAGACTCCAG<br>GAAGCGTAAGAAAGAGATTGTGTTTGGAGTCAGATTTCAATGTGAAACCCATGCCTTACATTTACACAGCACTTTGTAGTTTGCAA<br>ATTGGTGTGTTTTCAGCCCCCTCCCGCTGCCCCATGCTCTGAGATGATTGTGGATTATTACAGTGAAGTGCCTGGCCCGGAGCCCC<br>CAGTGATGAAGCAGGAACTTGAGTCTCAGGACTCCCAGCGGCTCTCTGCCCATTTCCTCCTCTCCGCCCCCCACCTCGCTTCACCT<br>GTTACCTTGTGAAGTTGCTGTTGGCACATAGCCCACTAGGAAACCAAGAAGTTTGACTGGGAGCGTGTGTTTCATTGCACTGGGCT<br>TAGCATACGGCTGGCCCTGGTGGCTGTTTGGCTAAATTCTCCATTTGAAACCTAAAGGGCCCTCTCTGTGCTTGAGCACAGTCTCC<br>TCCTAGTGGTCCTGCCTCAACCTGCTGGCGGGCTGTCTATGGATTGGGGTTTCACCTAATCATGCTGTGTTTCCTTTCTTTTCTTT<br>CTGTACATTAGACTACTTGGGAGGTGCTGTGTGATCCTTGGATGAAAAACATATATTTAAAGAAATGGAGAGTGTTTATTTTGTTT<br>GCTTTTTGAGGCATGTGCTGTCAAATGTTAGAGACCAAACTTAGTGATTAGAGGTTGGTCCTTTGACCTTCTTCTCTTAATTGCTT<br>TTCATGTAATCATGATAATTTACTCAGGTAGCACTCCAGTCACAAACAATGTCACAGAGATGAAACAGATTCAAAGAAAAAATATT<br>TTTAAGTCTTTTGAAAAGAAGTGCTATTCAAATTTAAGACATGTTTAAATTCATAGGTACATTATCTCTTAGTAAGAAATACTTTT<br>TTTTTTCTTTTTTTAGACAGAGTCTTGCTCTGTTGCCCAGGCTGGAGTGCAGTGGCACGATTTTAGCTCACTGCAACCTCTGCCTC<br>CCTGGTTGAAGTGATTCTCCTGCCTCAGCCTCCCGAGTAGCTGGGACTACGCCCGGCTAATTTTTATATTTTTAGTAGAGACGGG<br>GTTTACCATGTTGCCCAGGCTGGTTTCAAACTCCTGACCTCAGGTGATCTGCCTGCCTCTGCCTCCCAGAGTGCTGGGATTACAGG<br>TGTGAGCCACCACACCTGGCCGAAAGACAGTATTTTGATATAGCCACATACATGATTTAATGAGTAATGTTAAGTACAGAAAAGCT<br>GCCATATCCACATAGTTTTAGGGGGCATTTCTTCTTCAGTCTAACAAGAATATGATATCCAATTGTGGTTTTCCAATTTATTTCTC<br>TTCCAATTTCTTTTGTATACCTCACAGGAGAAATTGAATCCTAGAACTGGGAGATGACTGCCCTGCCCAGGGTTTTGTAATACATA<br>ATTGAAAATAAAAGTCCCTGAAACTAAATGTTTGCAGCCTGTATGAAATGGACTGTGGAAGGGGGATAATTTCTCTCCTCACAGAA<br>AGCCACTCGTCTCCTTGAATGAGGCATTGAGCAGACACACGTTTCTCTGTGTCGTGGGGCAGGAAGCAATTCCCTTGCCTCTTCAG<br>CACATCTCAGTTCTTTCCCACATGACCCCAGAACCACATAGAAAACATTGAAAATAATGGATTCTTCATTGTATTTGAATTTTTTT<br>TTTTTAACCTTTAGCCCAAAAGGGAAGTGTGCCTCGTGGAAAGAGCAAATGCCGTAAAATAGAAACCAGGAGTTTTAATCGCCATA<br>TATTTTAATGTGCTTGCATGATGGGAATGTGACTTTTAGCACTGCATGGTGTTTGGGGGCAAGATATTAATGTGGAAATCTTAGCT<br>TAAGTTTTACTGTGCTCTCATCCTGTGTCAGCTACCCCTCTAAACTGAAAAAGAGGCATGGCTCATTTCTCTCCTGCTTTATGTTT<br>TTGAGGTTGACTTGTAAGATAAAAATAAAAATAAGAAAAAAATATATCTAGGCAAATGACATGAAAAAAAAGTTGAAATATACTAC<br>TGGTGTTCATTTTTGTCCTGCAGTGTTGCTTTCTCAAAGAAATAAACATGTGGCTGGAAGTGTTT |
| 45 | CAGTCACATTTCAGCCACTGCTCTGAGAATTTGTGAGCAGCCCCTAACAGGCTGTTACTTCACTACAACTGACGATATGATCATCT<br>TAATTTACTTATTTCTCTTGCTATGGGAAGACACTCAAGGATGGGGATTCAAGGATGGAATTTTTCATAACTCCATATGGCTTGAA<br>CGAGCAGCCGGTGTGTACCACAGAGAAGCACGGTCTGGCAAATACAAGCTCACCTACGCAGAAGCTAAGGCGGTGTGTGAATTTGA<br>AGGCGGCCATCTCGCAACTTACAAGCAGCTAGAGGCAGCCAGAAAAATTGGATTTCATGTCTGCTGCTGGATGGATGGCTAAGG<br>GCAGAGTTGGATACCCCATTGTGAAGCCAGGGCCCAACTGTGGATTTGGAAAAACTGGCATTATTGATTATGGAATCCGTCTCAAT<br>AGGAGTGAAAGATGGGATGCCTATTGCTACAACCCACACGCAAAGGAGTGTGGTGGCGTCTTTACAGATCCAAAGCAAATTTTTAA<br>ATCTCCAGGCTTCCCAAATGAGTACGAAGATAACCAAATCTGCTACTGGCACATTAGACTCAAGTATGGTCAGCGTATTCACCTGA<br>GTTTTTTAGATTTTGACCTTGAAGATGACCCAGGTTGCTTGGCTGATTATGTTGAAAATATGACAGTTACGATGATGTCCATGGC<br>TTTGTGGGAAGATACTGTGGAGATGAGCTTCCAGATGACATCATCAGTACAGGAAATGTCATGACCTTGAAGTTTCTAAGTGATGC<br>TTCAGTGACAGCTGGAGGTTTCCAAATCAAATATGTTGCAATGGATCCTGTATCCAAATCCAGTCAAGGAAAAATACAAGTACTA<br>CTTCTACTGGAAATAAAAACTTTTTAGCTGGAAGATTTAGCCACTTATAAAAAAAAAAAAAGGATGATCAAAACACACAGTGTTT<br>ATGTTGGAATCTTTTGGAACTCCTTTGATCTCACTGTTATTATTAAACATTTATTTATTATTTTTCTAAATGTGAAAGCAATACATA<br>ATTTAGGGAAAATTGGAAAATATAGGAAACTTTAAACGAGAAATGAAACCTCTCATAATTCCCACTGCATAGAAATAACAAGCGTT<br>AACATTTTCATATTTTTTCTTTCAGTCATTTTTCTATTTGTGGTATATGTATATATGTACCTATATGTATTTGCATTTGAAATTT<br>TGGAATCCTGCTCTATGTACAGTTTTGTATTATACTTTTTAAATCTTGAACTTTATAAACATTTTCTGAAATCATTGATTATTCTA<br>CAAAAACATGATTTTAAACAGCTGTAAAATATTCTATGATATGAATGTTTTATGCATTATTTAAGCCTGTCTCTATTGTTGGAATT<br>TCAGGTCATTTTCATAAATATTGTTGCAATAAATATCCTTGAACACAAAAAAAAAAAAAAAAA |

Group 3

|    |    |
|----|----|
| 46 | GCAGCCGCCACCGCCGCCGCCGCCGCCACCAGAGCCGCCCTGTCCGCGCCGCGCCTCGGCAGCCGGAACAGGGCCGCCGTCGGGGA<br>GCCCCAACACACGGTCCACAGCTCATCATGATGGACTTGGAGCTGCCGCCGCCGGGACTCCCGTCCCAGCAGGACATGGATTTGAT<br>TGACATACTTTGGAGGCAAGATATAGATCTTGGAGTAAGTCGAGAAGTATTTGACTTCAGTCAGCGACGGAAAGAGTATGAGCTGG<br>AAAAACAGAAAAAACTTGAAAAGGAAAGACAAGAACAACTCCAAAAGGAGCAAGAGAAAGCCTTTTTCGCTCAGTTACAACTAGAT<br>GAAGAGACAGGTGAATTTCTCCCAATTCAGCCAGCCCAGCACATCCAGTCAGAAACCAGTGGATCTGCCAACTACTCCCAGGTTGC<br>CCACATTCCCAAATCAGATGCTTTGTACTTTGATGACTGCATGCAGCTTTTGGCGCAGACATTCCCGTTTGTAGATGACAATGAGG<br>TTTCTTCGGCTACGTTTCAGTCACTTGTTCCTGATATTCCCGGTCACATCGAGAGCCCAGTCTTCATTGCTACTAATCAGGCTCAG<br>TCACCTGAAACTTCTGTTGCTCAGGTAGCCCCTGTTGATTTAGACGGTATGCAACAGGACATTGAGCAAGTTTGGGAGGAGCTATT<br>ATCCATTCCTGAGTTACAGTGTCTTAATATTGAAAATGACAAGCTGGTTGGACATCCATGGTTCCAAGTCCAAGAGCCAAACTGA<br>CAGAAGTTGACAATTATCATTTTTACTCATCTATACCCTCAATGGAAAAAGAAGTAGGTAACTGTAGTCCACATTTTCTTAATGCT<br>TTTGAGGATTCCTTCAGCAGCATCCTCTCCACAGAAGACCCCAACCAGTTGACAGTGAACTCATTAAATTCAGATGCCACAGTCAA<br>CACAGATTTTGGTGATGAATTTTATTCTGCTTTCATAGCTGAGCCCAGTATCAGCAACAGCATGCCCTCACCTGCTACTTTAAGCC<br>ATTCACTCTCTGAACTTCTAAATGGCCCATTGATGTTTCTGATCTATCACTTTGCAAACTTTCAACCAAAACCACCCTGAAAGC<br>ACAGCAGAATTCAATGATTCTGACTCCGGCATTTCACTAAACACAAGTCCCAGTGTGGCATCACCAGAACACTCAGTGGAATCTTC<br>CAGCTATGGAGACACACTACTTGGCCTCAGTGATTCTGAAGTGGAAGAGCTAGATAGTGCCCCTGGAAGTGTCAAACAGAATGGTC<br>CTAAAACACCAGTACATTCTTCTGGGGATATGGTACAACCCTTGTCACCATCTCAGGGGCAGAGCACTCACGTGCATGATGCCCAA<br>TGTGAGAACACACCAGGAAAGAATTGCCTGTAAGTCCTGGTCATCGAAAACCCCATTCACCAAAGACAAAATCTACAAAGCCGCTT<br>GGAGGCTCATCTCACAAGAGATGAACTTAGGGCAAAAGCTCTCCATATCCCATTCCCTGTAGAAAAAATCATTAACCTCCCTGTTG<br>TTGACTTCAACGAAATGATGTCCAAAGAGCAGTTCAATGAAGCTCAACTTGCATTAATTCGGGATATACGTAGGAGGGGTAAGAAT<br>AAAGTGGCTGCTCAGAATTGCAGAAAAGAAAACTGGAAAATATAGTAGAACTAGAGCAAGATTTAGATCATTTGAAAGATGAAAA<br>AGAAAAATTGCTCAAAGAAAAAGGAGAAAATGACAAAAGCCTTCACCTACTGAAAAAACAACTCAGCACCTTATATCTCGAAGTTT<br>TCAGCATGCTACGTGATGAAGATGGAAAACCTTATTCTCCTAGTGAATACTCCCTGCAGCAAACAAGAGATGGCAATGTTTTCCTT |

TABLE 1-continued

Sequences Table. First column: SEQ ID No. Second column: corresponding mRNA sequence. For the 3 different groups, see explanation in the text.

```
   GTTCCCAAAAGTAAGAAGCCAGATGTTAAGAAAAACTAGATTTAGGAGGATTTGACCTTTTCTGAGCTAGTTTTTTTGTACTATTA
   TACTAAAAGCTCCTACTGTGATGTGAAATGCTCATACTTTATAAGTAATTCTATGCAAAATCATAGCCAAAACTAGTATAGAAAAT
   AATACGAAACTTTAAAAAGCATTGGAGTGTCAGTATGTTGAATCAGTAGTTTCACTTTAACTGTAAACAATTTCTTAGGACACCAT
   TTGGGCTAGTTTCTGTGTAAGTGTAAATACTACAAAAACTTTATTATACTGTTCTTTATGTCATTTGTTATATTCATAGATTTATAT
   GATGATATGACATCTGGCTAAAAAGAAATTATTGCAAAACTAACCACTATGTACTTTTTTATAAATACTGTATGGACAAAAAATGG
   CATTTTTTATATTAAATTGTTTAGCTCTGGCAAAAAAAAAAAATTTTAAGAGCTGGTACTAATAAAGGATTATTATGACTGTTAAA
   AAAAAAAAAAAAAAAAAAAAAAAAAAAAAAAA

47 CGGGCACTCACCGTGTGTAGTTGGCATCTCCGCGCGTCCGGACACCCGATCCCAGCATCCCTGCCTGCAGGACTGTTCGTGTTCAG
   CTCGCGTCCTGCAGCTGTCCGAGGTGCTCCAGTTGGAGGCTGAGGTTCCCGGGCTCTGTCGCTGAGTGGGCGGCGGCACCGGCGGA
   GATGCCTGGGAAGAAGGCGCGCAAGAACGCTCAACCGAGCCCCGCGCGGGCTCCAGCAGAGCTGGAAGTCGAGTGTGCTACTCAAC
   TCAGGAGATTTGGAGACAAACTGAACTTCCGGCAGAAACTTCTGAATCTGATATCCAAACTCTTCTGCTCAGGAACCTGACTGCAT
   CAAAAACTTGCATGAGGGGACTCCTTCAAAAGAGTTTTCTCAGGAGGTGCACGTTTCATCAATTTGAAGAAAGACTGCATTGTAAT
   TGAGAGGAATGTGAAGGTGCATTCATGGGTGCCCTTGGAAACGGAAGATGGAATACATCAAAGTGAATTTCTGTTCAAGTTTTCCC
   AGATTATCATTCTTTGGGATGAGAGAACATTATAAAACCACTTTGTTTATTTTAAAGCAAGAATGGAAGACCCTTGAAAATAAAGA
   AGTAATTATTGACACATTTCTTTTTTACTTAGAGAATCGTTCTAGTGTTTTGCCGAAGATTACCGCTGGCCTACTGTGAAGGTAG
   ATGACCTGTGATTAGACTGGGCGGCTGGGGAGAAACAGTTCAGTGCATTGTTGTTGTTGCTGTTTTTGGTGTTTTGCTTTTCAGTG
   CCAACTCAGCACATTGTATATGATTCGGTTTATACATATTACCTTGTTATAATGAAAAAACTCATTCTGAGAACACTGAAATGTTA
   TACTCAGTGTTGATTCTTCGGTCACTACACAACGTAAAATCATTTGTTTCTTTTGACTCAAATTGTATTGCTTCTGTTCAGATGA
   TCTTTCATTCAATGTGTTCCTGTTGGGCGTTACTAGAAACTATGGAAAACTGGAAAATAACTTTGAAAAAATTGGATAAAGTATAG
   GAGGGTTACTTGGGGCCAGTAAATCAGTAGACTGAACATTCAATATAATAAAAGAACATGGGGATTTTGTATAACCAGGGATAATA
   AAAAGAAAAGAAGTTAATTTTTAATTGATGTTTTTGAAACTTAGTAGAACAAATATTCAGAAGTAACTTGATAAGATATGAATGT
   TTCTAAAGAGTTTCTAAAGGTTCGAAATGCTCCTTGTCACATTAGTGTGCATCCTACAAAAGTGATCTCTTAATGTAAATTAAGA
   ATATTTTCATAATTGGAATATACTTTTCTTAAAAAAAAGGAACAGTTAGTTCTCATCTAGAATGAAAGTTCCATATATGCATTGGT
   GAATATATATGTATACACATACTTACATACTTTATATAGGCTTCTGTATAGAATTTGTATTAGAGTATTATATAGCTTCTTAGTA
   GGGTCTCAAGTAAGTTCATTTTTTTATCTGGGCTATATACAGTCCTCAAATAAATAATGTCTTGATTTTATTTCAGCAGGAATAA
   TTTTATTTATTTTGCCTATTTATAATTAAAGTATTTTTCTTTAGTTTGAAATGTGTATTAAAGTTACATTTTTGAGTTACAAGAGT
   CTTATAACTACTTGAATTTTTAGTTAAAATGTCTTAATGTAGGTTGTAGTCACTTTAGATGGAAAATTACCTCACATCTGTTTTCT
   TCAGTATTACTTAAGATTGTTTATTTAGTGGTAGAGAGATTTTTTTTTCAGCCTAGAGGCAGCTATTTTACCATCTGGTATTTAT
   GGTCTAATTTGTATTTAAACATATGCACACATATAAAAGTTGATACTGTGGCAGTAAACTATTAAAAGTTTTCACTGTT

48 ACGTAGCGCGGCGCTCGGAACTGACCTACTAACACACATCTCTCCGCGCGCCACGGCGCCCGCGGACCCCGGCGCGCCCGCCCGCC
   TCCCGCGCCGCGCCCTCGCCGCCGCCCGCCTCCCGCCGCCGCCCGGGAGGCCCGGCCCGGCCCCGAGCCCCGAGCGCCGGCGGCCCG
   ACTCCCGGCCGCCCCCTTTCTTTCTCCTCGCCGGCCCGAGACGCAGGAACACGGATAACGAAGGAGGCCCAACTTCATTCAATAAGGAG
   CCTGACGGATTTATCCCAGACGGTAGAACAAAAGGAAGAATATTGATGGATTTTAAACCAGAGTTTTTAAAGAGCTTGAGAATACG
   GGGAAATTAATTTGTTCTCCTACACACATAGATAGGGTAAGGTTGTTTCTGATGCAGCTGAGAAAAATGCAGACCGTCAAAAAGGA
   GCAGGCGTCTCTTGATGCCAGTAGCAATGTGGACAAGATGATGGTCCTTAATTCTGCTTTAACGGAAGTGTCAGAAGACTCCACAA
   CAGGTGAGGAGCTGCTTCTCAGTGAAGGAAGTGTGGGGAGAACAAATCTTCTGCATGTCGGAGGAAACGGGAATTCATTCCTGAT
   GAAAAGAAAGATGCTATGTATTGGGAAAAAAGGCGGAAAAATAATGAAGCTGCCAAAAGATCTCGTGAGAAGCGTCGACTGAATGA
   CCTGGTTTTAGAGAACAAACTAATTGCACTGGGAGAAGAAAACGCCACTTTAAAAGCTGAGCTGCTTTCACTAAAATTAAAGTTTG
   GTTTAATTAGCTCCACAGCATATGCTCAAGAGATTCAGAAACTCAGTAATTCTACAGCTGTGTACTTTCAAGATTACCAGACTTCC
   AAATCCAATGTGAGTTCATTTGTGGACGAGCACGAACCCTCGATGGTGTCAAGTAGTTGTATTTCTGTCATTAAACACTCTCCACA
   AAGCTCGCTGTCCGATGTTTCAGAAGTGTCCTCAGTAGAACACACGCAGGAGAGCTCTGTGCAGGGAAGCTGCAGAAGTCCTGAAA
   ACAAGTTCCAGATTATCAAGCAAGAGCCGATGGAATTAGAGAGCTACAAGGGAGCCAAGAGATGACCGAGGCTCTTACACAGCG
   TCCATCTATCAAAACTATATGGGGAATTCTTTCTCTGGGTACTCACACTCTCCCCACTACTGCAAGTCAACCGATCCTCCAGCAA
   CTCCCGAGAACGTCGGAAACTGATGATGGTGTGGTAGGAAAGTCATCTGATGGGAGACGAGCAACAGGTCCCAAGGGCCCCA
   TCCATTCTCCAGTTGAACTCAAGCATGTGCATGCAACTGTGGTTAAAGTTCCAGAAGTGAATTCCTCTGCCTTGCCACACAAGCTC
   CGGATCAAAGCCAAAGCCATGCAGATCAAAGTAGAAGCCTTTGATAATGAATTTGAGGCCACGCAAAAACTTTCCTCACCTATTGA
   CATGACATCTAAAAGACATTTCGAACTCGAAAAGCATAGTGCCCCAAGTATGGTACATTCTTCTCTTACTCCTTTCTCAGTGCAAG
   TGACTAACATTCAAGATTGGTCTCTCAAATCGGAGCACTGGCATCAAAAGAACTGAGTGGCAAAACTCAGAATAGTTTCAAAACT
   GGAGTTGTTGAAATGAAAGACAGTGGCTACAAAGTTTCTGACCCAGAGAACTTGTATTTGAAGCAGGGGATAGCAAACTTATCTGC
   AGAGGTTGTCTCACTCAAGAGACTTATAGCCACACAACCAATCTCTGCTTCAGACTCTGGGTAAATTACTACTGAGTAAGAGCTGG
   GCATTTAGAAAGATGTCATTTGCAATAGAGCAGTCCATTTTGTATTATGCTGAATTTTCACTGGACCTGTGATGTCATTTCACTGT
   GATGTGCACATGTTGTCTGTTTGGTGTCTTTTTGTGCACAGATTATGATGAAGATTAGATTGTGTTATCACTCTGCCTGTGTATAG
   TCAGATAGTCCATGCGAAGGCTGTATATATTGAACATTATTTTTGTTGTTCTATTATAAAGTGTGTAAGTTACCAGTTTCAATAAA
   GGATTGGTGACAAACACAGAAAAAAAAAAAAAAAAAAA

49 GCTGACGTCGCCGGGGCCCGGCGTCGCGTCAGGGCTGGCCGGCGGCGGAGGCGGCGGCGGCGGCGGCGATGGCAGCGGACCCTGAG
   CGAGCTTGAGGGCTCGGACCCAGCTCCCTCCCGCGAAACCTTGGGCGGATCCGGCGCTGCGGCCCCAGCTCGCTCCGCTCCTGCTC
   CCTCCCCGGCCGCTGCCTGGGCGGAGGCAGAGGCAGAGGCCCGGGCTGGCCGCCCTGCTCGTGCCCCAGCTCGGCCCCGGACGGCC
   CGGCTGCTGTGCAGAGAGGAGGCCGAGTCGGTAGTGAAAAGAGAATACTGAAGAATAGGATCTCAAGATGAGTAAAAAGCCCCCAA
   ATCGCCCTGGAATCACTTTTGAGATTGGTGCTCGTTTGGAGGCACTGGACTACTTACAAAAATGGTATCCATCACGAATTGAAAAA
   ATTGACTATGAGGAGGGCAAGATGTTGGTCCATTTTGAGGCTGGTCATCGTTATGATGAGTGGATTTTACTGGGATACACAATAG
   ATTGCGACCCCTTGAGAGACAGCACTAAGAAAAGAAGGGCTAAAAGATGAGGAAGATTTCTTTGATTTTAAAGCTGGAAGAAGAAG
   TTCTGGCTCGTTGGACAGACTGTCGCTATTACCCTGCCAAGATTGAAGCAATTAACAAAGAAGGAACATTTACAGTTCAGTTTTAT
   GATGGAGTAATTCGTTGTTTAAAAGAATGCACATTAAAGCCATGCCCGAGGATGCTAAGGGGCAGGTGAAATCCCAGCATCCACT
   AAGCTGGTGTTGTCCTATCGACCCAGCTGGATCGTGTAACCAGTCTATGGGAAGTGAGCATTGGATAGCTTTAGTCAAAAGCAGCTG
   CTGCAGCTGCAGCCAAGAACAAAACAGGGAGTAAACCTCGAACCAGCGCTAACAGCAATAAAGATAAGGATAAAGATGAGAGAAAG
   TGGTTTAAAGTACCTTCAAAGAAGGAGGAAACTTCAACTTGTATAGCCACACCAGACGTAGAGAAGAAGGAAGATCTGCCTACATC
   TAGTGAAACATTTGGACTTCATGTAGAGAACGTTCCAAAGATGGTCTTTCCACAGCCAGAGCACATTATCAAACAAGAGGAAAA
   ATAATCAAGGCAACTCGTTTCAGGCAAAGAGAGCTCGACTTAACAAGATTACTGGTTTGTTGGGCAACCAAAGCTGTTGGGGTTGAT
   GGTGCTGAAAAAAGGAAGACTACAATGAAACAGCTCCAATGCTGGAGCAGGCGATTTCACCTAAACCTCAAAGTCAGAAAAAAA
   TGAAGCTGACATTAGCAGTTCTGCCAACACTCAGAAACCTGCACTGTTATCCTCAACTTTGTCTTCAGGGAAGGCTCGCAGCAAGA
   AATGCAAACATGAATCTGGAGATTCTTCTGGGTGTATAAAACCCCCTAAATCACCACTTTCCCCAGAATTAATACAAGTCGAGGAT
   TTGACGCTTGTATCTCAGCTTTCTTCTTCAGTGATAAATAAAACTAGTCCTCCACAGCCTGTGAATCCCCCTAGACCTTTCAAGCA
   TAGTGAGCGGAGAAGAAGATCTCAGCGTTTAGCCACCTTACCCATGCCTGATGATTCTGTAGAAAAGGTTTCTTCTCCCTCTCCAG
```

TABLE 1-continued

Sequences Table. First column: SEQ ID No. Second column: corresponding mRNA sequence. For the 3 different groups, see explanation in the text.

```
CCACTGATGGGAAAGTATTCTCCATCAGTTCTCAAAATCAGCAAGAATCTTCAGTACCAGAGGTGCCTGATGTTGCACATTTGCCA
CTTGAGAAGCTGGGACCCTGTCTCCCTCTTGACTTAAGTCGTGGTTCAGAAGTTACAGCACCGGTAGCCTCAGATTCCTCTTACCG
TAATGAATGTCCCAGGGCAGAAAAAGAGGATACACAGATGCTTCCAAATCCTTCTTCCAAAGCAATAGCTGATGGAAGAGGAGCTC
CAGCAGCAGCAGGAATATCGAAAACAGAAAAAAAAGTGAAATTGGAAGACAAAAGCTCAACAGCATTTGGTATCAGGAGTTGGGAT
TTCTCAGCACTGCTAATGAAGATCCCCTCTTATAGTCCAATAAGCTTATCAGGACTTCCAGAGTCATGACATGAACAGTTTAATTG
AACCCATCCACTCTGGGCAGGTAAGAGAAAAGAAAAAGATAAGGAAGAAGAGAGAAGAGAGACAAAGATCACTACAGACCAAAAC
AGAAGAAGAAGAAAAAAAAGAAAAGAAATCTAAGCAACATGACTATTCAGACTATGAAGACAGTTCCCTCGAATTTTGGAAAGG
TGCTCTTCTCCACTAACTCGATCTTCTGGGAGTTCTCTGGCTTCACGAAGCATGTTTACGGAGAAAACTACAACCTATCAGTACCC
AAGGGCAATTCTATCCGTTGATCTTAGTGGTGAAAACTTATCAGATGTAGACTTCCTAGATGATTCTTCAACGGAGAGTTTGCTTC
TGAGTGGGGATGAATACAATCAGGACTTTGATTCAACCAATTTTGAGGAATCTCAGGATGAGGATGATGCTCTTAATGAAATTGTG
CGATGTATTTGTGAGATGGATGAGGAGAATGGCTTCATGATCCAGTGTGAAGAGTGCTTGTGTTGGCAACACAGCGTGTGCATGGG
GCTGCTGGAGGAGAGCATTCCAGAGCAGTACATCTGCTATATCTGCCGGGACCTCACCAGGTCAGAGGTGGAGTGCAAAATATCGTT
ATGATAAGGAGTGGTTGAATAATGGGAGAATGTGCCGGGTTATCATTTTTCAAAGAAAATTATTCTCATCTCAATGCCAAAAAGATA
GTTTCTACACATCACCTGCTTGCTGATGTCTATGGTGTTACAGAAGTGCTACACGGGCTACAGCTGAAGATTGGAATACTAAAGAA
TAAACATCATCCTGACCTTCATCTCTGGGCTTGTTCCGGGAAGCGAAAAGACCAAGATCAAATAATAGCTGGGGTGGAGAAAAAA
TAGCTCAAGACACAGTTAATCGAAGAAAAGAAATATGTACAGAACCATAAAGAACCACCTCGTTTGCCCCTAAAAATGGAAGGA
ACTTATATAACAAGTGAGCATAGCTATCAAAAGCCACAAAGTTTTGGTCAGGACTGTAAATCTCTCGCAGACCCTGGGAGCTCAGA
TGATGATGATGTTAGTAGTTTGGAAGAAGAACAAGAATTCCACATGAGAAGTAAAAACAGTTTACAGTACTCAGCAAAAGAACATG
GAATGCTGAAAAGAATCCAGCTGAAGGGAATACAGTATTTGTTTATAATGATAAAAAGGGCACCGAAGACCCAGGAGACTCACAT
CTTCAGTGGCAGCTCAATCTCCTTACACACATAGAAAATGTGCAGAACGAAGTTACCAGCAGGATGGACCTAATAGAAAAGAAGT
CGATGTTCTGGAAAGCTGGCTTGATTTCACAGGGGAGTTGGAGCCACCAGATCCTCTTGCAAGATTGCCCCAACTTAAACGCCACA
TAAAACAGCTCCTAATTGACATGGGCAAAGTACAGCAGATAGCAACTCTTTGCTCTGTATGACAACAGTGAACACTTAATGAAAGA
ATGTGGCTTTCTTCAGTCAAAGCATTTTTATTATCCACGTGATGGCTAAGTGGATAATTTAAAAGCTTAGTAATGTCTGGTCATTC
ACTGATTTGTGATGTCAATAGGATGGCACCTTGGAAAGAAAAATGAAGAACAACTTTATCAAGGAAGCTAGTATTTAAAAACAAAT
TCATGAGCAAGCTGCAAATGAGAATGTGTTATATGCCAAGGAACAATAGTAGAATATAATGTATACTAAGGGATTTCAAGTTCT
CAGAATTTTTGAGTAGTTGCTTACGTGAAGCTCAAGATACCTGTAGAAAGAAATATGGTATATTTGTATAGTTTTTAATAGAAAGA
TCTATGTTTATAAACCAGCACTTGGCCAAAAACAAAATTGTAAAGGAAATTTAAATTCTGGAGAATTCTACAGGGTTGCTCTAAGA
ACTGTCTTCTCAGCAGTTGATCCAGCTGTACGGAAATTTAGGGTATTTAAACTTTTAAAGGATCATGAGCTGTTTCTTGGGCGATG
AATGTTCTCAATCAGAAAACTGACAGTAGAAATCTCACTTCTGGGGAAAACAGTTGTGGAATTCTTACTTCATTATGAATGTATTT
AAAAAACAAACACCCAAATAATTGGAATATATTGCAGGCATTAAGCTCATTAAAAACAAACTGGCTTGCAGAAGGGTCCGATGTGCC
AAGTGATCATGATTCTGCTGGAAAGAGGATTTTAAATATTGTGGGAGTTCTCCCACCCTAAGTCTTACATAATGCCACCAGTCCAT
CCAAAACCTATATATCACCTATACTATATATATCATATATATAGTTGAATGGCAGTATTCAGGCTCAACGTACAGTTTGATCCTGA
GTATGCTTGGTGTTTGCCTTCAGAAAAAAAAAAATACATTGTAAATAACCTCAGCTGGGATGAGGAGTGACAGAATATCAAATAA
TTTGTGCTGTGGATTTTTTAACTGCTAGTAGTGGAATACTGGAAAAGCTTCATTTCTGAAGATGAATTTTATTTTTAAAAAAATA
CATGCACACTCAAAACTTTTAGCTTTGATCACAAGTGGACAAATTTCTGAAACCAAAGGCAACTAAGTTGCTGTGTTAGCTCTTGC
TGGATTTTGAGCCTAGGTCCTACTGTCTGCCAGTACTCATGTGAGTTGTATGTGCCCCAGTGCTACATACGCAGGTATGCGTAAG
TGTGTATGTTTGTTTTAAACAAACACTCAACGTACATATGTACATAATCTACACATATTTATATCACATATCTAGTTTTATTACTA
TAGACTATACGAATTGGTGGTTAACATGAAATGTTACCTTTTAACGACTGTTTTTAAAAATTAAAAATGTATGTATAGGTTTTGA
AATTTTTTTAAAAGGGGAGAAAGACTGTTAAGAGGAGGCTATTTGATGACATAACACTTGAATATTTTATGCCTCATTCTGTTTAT
CAGTTCTCGCAATCTGTATAAATGCATTTTAGAACTGATAGACAGTAAACTTGAATTTATCTTTGATAAGAATACATGCCACTGTA
CATTCAGATATTATTTAAATTTGCAAACACATTGTTCTATATGTAAGGGTACTGTATGTAAAACTCTGTATTAAAACTATTCCACA
TATCCTAAAATTTCAGCTTGCCTTTTTGCGGCCTTATATTTTGATGTAAAGATTAAAAGAATGATGTGCAAAACAGTCAGAAATTTTTA
TTGCCTTTTGAGATTCTCCAACTTGACAAATGTGCCAAAGATCAACAGACAGAAAATATCATCCTGTGTATTTACTTGTCATACTT
TAACTTTGTGAAAGATCTTACTGATAAATGAAAAGCTTTAGCAGAGGTGGTATTGTGGGTAATTGCTTAAATTTACATATCAAAG
TAAAAAAGTAGTGCCTGTAAAAAAAAAAAAAAAAAA
```

50 ```
CGGATGTGTGCCTGGCGCCGGAAGAGAAGACGGCCCCCCTCTCTCGGCCCGGCCATCTTGTGGGAAGAGCTGAAGCAGGCGCTCTT
GGCTCGGCGCGGCCCGCTGCAATCCGTGGAGGAACGCGCCGCCGAGCCACCATCATGCCTGGGCACTTACAGGAAGGCTTCGGCTG
CGTGGTCACCAACCGATTCGACCAGTTATTTGACGACGAATCGGACCCCTTCGAGGTGCTGAAGGCAGCAGAGAACAAGAAAAAAG
AAGCCGCGGGGCGCGTTGGGGGCCCTGGGGCCAAGAGCGCGACTCAGGCCGCGCCCAACCAACTCCAACGCGGCAGGCAAA
CAGCTGCGCAAGGAGTCCCAGAAAGACCGCAAGAACCCGCTGCCCCCAGCGTTGGCGTGGTTGACAAGAAGAGGAGACGCAGCC
GCCCGTGGCGCTTAAGAAAGAAGGAATAAGACGAGTTGGAAGAAGACCTGATCAACAACTTCAGGGTGAAGGGAAATAATTGATA
GAAGACCAGAAAGGCGACCACCTCGTGAACGAAGATTCGAAAAGCCACTTGAAGAAAAGGGTGAAGGAGGCGAATTTTCAGTTGAT
AGACCGATTATTGACCGACCTATTCGAGGTCGTGGTGGTCTTGGAAGAGGTCGAGGGGGCCGTGGACGTGGAATGGGCCGAGGAGA
TGGATTTGATTCTCGTGGCAAACGTGAATTTGATAGGCATAGTGGAAGTGATAGATCTTCTTTTTCACATTACAGTGGCCTGAAGC
ACGAGGACAAACGTGGAGGTAGCGGATCTCACAACTGGGGAACTGTCAAAGACGAATTAACAGAGTCCCCAAATACATTCAGAAA
CAAATATCTTATAATTACAGTGACTTGGATCAATCAAATGTGACTGAGGAAACACCTGAAGGTGAAGAACATCATCCAGTGGCAGA
CACTGAAAATAAGGAGAATGAAGTTGAAGAGGTAAAAGAGGAGGGTCCAAAAGAGATGACTTTGGATGAGTGGAAGGCTATTCAAA
ATAAGGACCGGGCAAAAGTAGAATTTAATATCCGAAAACCAAATGAAGGTGCTGATGGGCAGTGGAAGAAGGGATTTGTTCTTCAT
AAATCAAAGAGTGAAGAGGCTCATGCTGAAGATTCGGTTATGGACCATCATTTCCGGAAGCCAGCAAATGATATAACGTCTCAGCT
GGAGATCAATTTTGGAGACCTTGGCCGCCCAGGACGTGGCCGGCAGGGGAGGACGAGGTGGACGTGGGCGTGGTGGGCGCCCAAACC
GTGGCAGCAGGACCGACAAGTCAAGTGCTTCTGCTCCTGATGTGGATGACCCAGAGGCATTCCCAGCTCTGGCTTAACTGGATGCC
ATAAGACAAACCCTGGTTCCTTTGTGAACCCTTCTGTTCAAAGCTTTTGCATGCTTAAGGATTCCAAACGACTAAGAAATTAAAAA
AAAAAGACTGTCATTCATACCATTCACACCTAAAGACTGAATTTTATCTGTTTTAAAATGAACTTCTCCCGCTACACAGAAGTAA
CAAATATGGTAGTCAGTTTTGTATTTAGAAATGTATTGGTAGCAGGGATGTTTTCATAATTTTCAGAGATTATGCATTCTTCATGA
ATACTTTTGTATTGCTGCTTGCAAATATGCATTTCCAAACTTGAAATATAGGTGTGAACAGTGTGTACCAGTTTAAAGCTTTCACT
TCATTTGTGTTTTTAATTAAGGATTTAGAAGTTCCCCAATTACAACTGGTTTTAAATATTGGACATACTTGGTTTTTAATACCTG
CTTTGCATATTCACACATGGTCAACTGGGACATGTTAAACTTTGATTTGTCAAATTTTATGCTGTGGAATACTAACTATATGTA
TTTTAACTTAGTTTTAATATTTTCATTTTGGGAAAAATCTTTTTCACTTCTCATGATAGCTGTTATATATATATGCTAAATCT
TTATATACAGAAATATCAGTACTTGAACAAATTCAAAGCACATTTGGTTTATTAACCCTTGCTCCTTGCATGGCTCATTAGGTTCA
AATTATAACTGATTTACATTTTGACTCTATATTTACTTTTTAAATGCTTGAGTTTCCCTTAAAATCTAAACTAGACATCATTAAT
TGGTGAAAGTTGTTTAAACTACTTATTGTTGGTAGGCACATCGTGTCAAGTGAAGTAGTTTTATAGGTATGGGTTTTTCTCCCCC
TTCACCAGGGTGGGTGGAATAAGTTGATTTGGCCAATGTGTAATATTTAAACTGTTCTGTAAAATAAGTGTCTGGCCATTTGGTAT
GATTTCTGTGTGTGAAAGGTCCCAAAATCAAATGGTACATCCATAATCAGCCACCATTTAACCCTTCCTTGTTCTAAAACAAAAA
CCAAAGGGCGCTGGTTGGTAGGGTGAGGTGGGGGAGTATTTTAATTTTTGGAATTTGGGAAGCAGACAGCTTTACTTTGTAAGGTT
GGAACAGCAGCACTATACATGAAATATAAACCAAAAACCTTTACTGTTTCTAAATTTCCTAGATTGCTATTATTTGGTTGTAAGTT
```

TABLE 1-continued

Sequences Table. First column: SEQ ID No. Second column: corresponding mRNA sequence. For the 3 different groups, see explanation in the text.

```
   GAGTATTCCACAGAAAGTGGTAATTATCTCTTCTCTCTTCCTCCATTAGAAAATTAGGTAAATAATGGATTCCTATAATGGGAGCA
   TCACCACTTATTAAAACACACATAGAATGATGAATTAAAAAAGTTTTCTAGGATTGTCTTTTATTCTGCCACATTTATTGATAAAC
   AGTGAAGGAATTTTTAAAAAATTTTTAAGAATTGTTTGTCACGTCATTTTTAGAAATGTTCTACCTGTATATGGTAATGTCCAGTT
   TTAAAAATATTGGACATCTTCAATCTTAAACATTTCTATTTAGCTGATTGGTTCTCACATATACTTCTAAAAGAAACTTTTATGTT
   ATAAGAGTTACTTTTTGGATAAGATTTATTAATCTCAGTTACCTACTATTCTGACATTTTAGGAAGGAGGTAATTGTTTTTAATGA
   TGGATAAACTTGTGCTGGTGTTTGGATCTTATGATGCTGAGCATGTTCTGCACTGGTGCTAATGTCTAATATAATTTTATATTTA
   CACACATACGTGCTACCCAGAGATTAATTTAGTCCATATGAACTATTGACCCATTGTTCATTGAGACAGCAACATACGCACTCCTA
   AATCAGTGTGTTTAGACTTTTCAAGTATCTAACTCATTTCCAAACATGTACCATGTTTTATAAACCTCTTGATTTCCAGCAACATA
   CTATAGAAAACACCTGCTACTCAAAACACAACTTCTCAGTGTCATCCATTGCTGCTGTGAGAGACAACATAGCAATATCTGGTATG
   TTGCAAGCTTTCAAGATAGCCTGAACTTAAAAGTTGGTGCATTAGTTGTATCTGATGGATATAAATTTGCCTCCTAGTTCACTTT
   GTGTCAAGAGCTAAAACTGTGAACCTAACTTTCTCTTATTGGTGGGTAATAACTGAAAATAAAGATTTATTTTCATGCTCACTTCT
   TAAAAGTCATAAAAACAATCAAATAGGATCATGTTTATTGTCATGTGTTTCCTGGTTTCTGACCTGTGTGCACACCCCTGTGTGTT
   TATAATTTTTAAATTGAATTTTATATGGGGTTTTTATTTGCTAAAAACCAGGCTGTTGAATCACATTTGGGAAGGGTACTTATCTT
   AATGACTAATGACTTAATTGGGAAAGTTGAATTCTTGTAAAATACAAAATCCAAGGACTTCTTGGATTTAATCTGATTGTCACTTC
   TTAGCAGATCACTTTTTTGATAATGAAAGTTAAGCATACTGAATGCTACTTTTGATTGACAAACTGGCTATAATAGTCTAGGGGAA
   AAATCCCTAAACAGATAAAGATTCCTAAAGTAATGGTGGCAGCTGATGTTTCAGTGAACTTTTATCTTGATGCGTTTAAATGGAAG
   TAATGCCAGACCTGAGATTTTTAAGGCATTTTTACAGCTTGTATTGAAATGATTGGAGACATGGTTTCTTTATTAGCTATTTTGAG
   ACCTGTGGAGTTAAGCAAGACTTTTAAAAATTGGCACCATATACATCTAGTTAGTTCCTTTACTCTTATTTTTTAAATAAAAGTA
   GTACACATCATTTCCAGGGTTGTAAATATATTTGGGCTTGTTTTTGGTATGGATTTAAAAGGAGGATATTAAGTATTCATTCTAA
   TTTTGTTATTTTCTAGTTGCCAGAGATGGTTGCACTGAAATAGAACAGGGAGTTGCATACAAAGCCTAAATGTGTATTGGATTTC
   GAAAATACTAGGTTGGTGCAATTGGTTTTGTACCAACCTAACATGTCTTTAGGAAAGTACCATCATGTGGAAGGAAACAACAGGTG
   TTAAAAGGTTCAAAGGAATGAGAAATAGGAAGTTACTAGAACCTAACTCTGATGTTGACCTTAGAGGTAAGATTATTCAGGTATATTA
   GTGGACCTCCAGTCCAATGGTATAGCAAATTCCAGGGATCTCAGGTGCATGCAATTTTACTTTCTAAAGTAAACACTTAGAAAATA
   GATTATAACCCAGACGTTTTGGATTATACTGAGACAAATATGTAAATAAGTTTTAGCAAGTCTGAACATGTACCAGCGAGATCTTC
   AGGTTAACTAAGAAAAGCCCAGAAACTTCATTATTTACTGTGCTTTGTATGGCATAACTGGTAACAAGGCAGTAAAATGATACATA
   TTTGAACTGGACCATAGTAATTAAATGATTTATCAATATCATTTGCAAGATAATTGTCAGGTTGAGTTAATAGTAAGTGGCAGCTT
   CCCAGAAATTTGGGTTATTTGGCCTAAGCTGTGCCCTGGGATTACCTCTTCATCTTCCTTGACTTTTAAGTTCAAATTTGGAGGTT
   ATGTGAAGTGATTGAAATAAATCTTTCAGGCTGAGGAAGTCGGTAATTTCAAGAATATAGTGAAAACAAGGTTGTAATCTAAACAT
   GAGAAGCTTAAGTTTAGGAAATGGTTAGAATATAAATTGCTAAAGCCATCATGATTTTGGCCACAGATGAAAATATGAACACTGGA
   AATGAGCGCCATTTAAATGAGATGCTGTATGTAAGCCAGGGGTCAGCAAAGTTCAGCCTGTGACCTGGTGTGTGTGGGGGTGTG
   TGTGTGTGTGTGTGTGTGTGTCCGTGTCCCTGAGTTAAGAATGGTTTTTAGGCTTGTATAGGATTAAAAAAAAAAAAAAAC
   CCACAGAAAATGTAGGCACCCCAGCATAAGATACCGCCTTTCACAGAAATGTTTGCTGACCCCGGAACTGTCACTCTCGGGTTAC
   AAGAGTTTGTTTCTTTGAAACAGTCTGGCTCTGTCACCCAGGCTGGAGTGCAGTGGCATGATCTCAGGTCACTGCAGCCTCCACCT
   CCCGGGTTCAAGCAATTCTGCCTCAGCCTCCTGAGTAGCTGGGATTACAAGGTGTGCACCACCACAGACAGCTAATTTTACAGGTGT
   ACACCACCACACCCAAGAATCACTTGAACCCGGGAGGTGGGGGTTGCAGTGAGCCAAGATCATAGCACTGTACTCCAGTCTGGGTG
   ACACACTGTCTGAAAAATAAAGTTTAGTTCTAGGTACAAATTAAGTGGTCTACCCAACAGGAAGCTGTGAAATTAGAAGTAATTT
   TAAAGCATACTTTACACCTCTATATAATCAAAGTAAGGGCAAGATAAAACTTGTTAGTAAAACATGTTTTATTATTTTTAGATAG
   GTAGCCTGCAACATAAAATATATTTTGAAAGCTGTTAAGGGGTGTATAATCTGTTAAAAAATACCATGATTAGTATTTCACATTTA
   GTGACTCAGATCCCTTTGTGTAAGTCCTTTGCGTTGTGCAAAGAGGTTTTTCTATGAGATGAGAATTATGAACACTTCATATAGGT
   AAATTCCATAGGTTGAGCTGGGGCAGAAATTAATGGCTCCTGGAGATTGCATCTTTTTTTTTTTTTTGAGCTTAGAATTCCCA
   TTTGGACAGAATTTAGCTTTTGTGCTGTTGATTACTTCTGTACTAAACTGGTAGCCAATTGTTCACTTCTAAATGGAAGGGAAAAA
   GTTACCCACACAAGTTAGAAAATGATTTACCGAATTATTTTTTGATGTATGATATATCTGTTTTAAATCAGTAATGTTTGTT
   CCTTTTGCTGCCCATTTGGGAGTATGTGGCAATTCCTAGTGCTCTTGTATGACATTACTCTTCTTGAGACTTGTATATGCAAGAAA
   GTATATATAAAGATGCCTGGTGGTAACTTTGTATCTGAGTTCTGATTCATTATGGACTTTTAGAAATCTATTTAGATAATTGGTT
   CATACTAGGTGCTCAATTACTCTGACCTTGTGTGGCTTAATCCTTAAATAGTTGCTTTAGGTGTTACTGGGTGGAAGCATGGAAAG
   TGAAGGGCTAATATTAAGGATTTTTATGTATTACTGAGTAGGGAAAGTGGGAAAGTGGTTATCTTTGGACAGTTGTATTACTTTGC
   ACTAATCACCTTGTTTGCAGTTGTAGCTGATTCAGTTCTAGATTTTAGGACCAAAAAGATCTCTAATTTAAAGAAACAGTTTTTAT
   ATACCTAGAATGAAGATTCTGTTTAAAGCGGTTTTGGTTAACTTGGTTCTTGACATTTGCCTAAAATTTTGTTGGATTGGGACTAA
   AATGTTCTATTAGCCAATGAATAACGTCCAAGTAAATTTTTGTTTTATTTTGGGAA

51 GAAGCAGGGAGCGCGGAGTCGTTCCCGAGAGAGGCGGCCAGGCTATGCTCGCCGGTTTCCGGCGTTCCGCTCCGGCCAGCCAGAGT
   CTCTGTCTCAACCTGTGTCCGTGCTCCAGCAGTCTCCTCAGCCCGGCCCCGCGGCGCGGTTGGCGGCGGCGCCCCAGGCGCGCCCC
   CTCCCTCCGATGGCGGCGGAGATCCAGCCCAAGCCTCTGACCCGCAAGCCGATCCTGCTGCAGCGGATGGAGGGGTCCCAGGAGGTG
   GTGAATATGGCCGTGATCGTGCCCAAAGAGGAGGGCGTCATCAGCGTCATCGACATGCCACAGTTCGTGTTTGGTTAAAGAGAGA
   CAGTGGACAGTATTGGCCAAGCGTATACCATGCAATGCCTTCTCCATGTTCATGCATGTCTTTTAACCCGGAAACAAGAAGACTGT
   CCATAGGTCTAGACAATGGTACAATCTCAGAGTTTATATTGTCAGAAGATTATAACAAGATGACTCCTGTGAAAAACTATCAAGCG
   CATCAGAGCAGAGTGACGATGATCCTGTTTGTCCTGGAGCTGGAGTGGGTGCTGAGCACAGGACAGGACAAGCAATTTGCCTGGCA
   CTGCTCTGAGAGTGGGCAGCGCCTGGGAGGTTATCGGACCAGTGCTGTGCCTCAGGCCTGCAATTTGATGTTGAAACCCGGCATG
   TGTTTATCGGTGACCACTCAGGCCAAGTAACAATCCTCAAACTGGAACAAGAAACTGCACCCTGGTCACAACATTCAGAGGACAC
   ACAGGTGGGGTGACCGCTCTCTGTTGGGACCCAGTCCAGCGGGTGTTGTTCTCAGGCAGTTCAGATCACTCTGTCATCATGTGGGA
   CATCGGTGGGAGAAAGGAACAGCCATCGAGCTCCAAGGACACAACGACAGAGTCCAGGCCCTCTCCTATGCACAGCACACGCGAC
   AATTGATCTCCTGTGGCGGTGATGGTGGGATTGTCGTCTGGAACATGGACGTGGAGAGGCAGGAGACCCCTGAATGGTTGGACAGT
   GATTCCTGCCAAAAGTGTGATCAGCCTTTCTTCTGGAACTTCAAGCAAATGTGGGACCGGTAAGGATCAAGTATTGGCTCCGCACCA
   CTGCCGCAAGTGTGGGAAGGCCGTCTGTGGCAAGTGCAGCTCCAAGCGCTCCTCCATCCCCCTGATGGGCTTCGAGTTTGAAGTGA
   GGGTCTGTGACAGCTGCCACGGAGGCCATCACAGATGAAGAACGTGCACCCACAGCCACCTTCCATGACAGTAAACATAACATTGTG
   CATGTGCATTTCGATGCAACCAGAGGATGGTTACTGACTTCTGGAACTGACAAGGTTATTAAGTTGTGGGATATGACCCCAGTCGT
   GTCTTGATGACTCTCCCAGGAATCAGAAAGATAGTATTTACTAAGAAGAAAGTTGTTTTAACCCAAATCATTACCAGAGTGGTAAA
   GCAGACATGTGAGAAGTAAGAAAGAAACTAAAGACCCTGAATGAATTTGCAGATTACCCATGTGCACAGTGGGACTCGGCCAGTG
   AGCACTCGCAAGGGGACTCTTCCAACTTGTTCATACAATATAAAAGAAGCTATTTTTTAACAAAAAAAAAAAAAAAAAAA

52 CTGCAGACTGGACTGGTCCACGGCAGGTGGATGCCATGTCTTGAAGACCCACAGGCACCCACTCATCCTCATGATCATGCAGTTCT
   CTGGTTTCTAACAGTGCAGTCTGGGTTGCAGTCTGGGAGTCCAGCAGAAGAGCAGGCCCTGGAATCCCAGGTGTGGGGCGTGG
   CTTAACGTGGAGTTTCCTTCAGAGGCAGTGAGTGCTTGTCATTGTCTCCGTCAGCATTGGCTTTGGGCCTAGTGTGGCCTCGAACC
   TTCTGTTGGGATCAGCAGTGGAACAGTAGGAAAAGGAATGAGTAGACATGGCATTGCAACAAGTCTTTTTTTTTTTTCCGGTAGA
   ATTATCATATTAAGCAGAAGTTTTGCTTCACAAACTCTCAGCCAAATACAAATACTATGAATAGTATTTACCTTGTGTCTCTTTC
   CAAAGAACTCATAGTGGTTTGCAGCTATTGCAGATATCCTGGCCATGCGGTATGCGGTTCCTTTTTTTTGTTTTTTTTTTTTTT
```

TABLE 1-continued

Sequences Table. First column: SEQ ID No. Second column: corresponding mRNA sequence. For the 3 different groups, see explanation in the text.

```
GAGACGGAGCCTTGCTCTGTCGCCCAGGCTGGAGCATAGTGGCGCGATCTCGGCTCACTGCAAGCTCCGCCTCCCGGGTTCGTGCC
ATTCTCCTGCCTCAGCCTCCCGAGTAGCTGGGACTACAGGCGCCCGCCACCACACCCGGCTAATTTTTGTATTTTTAGTAGAGACG
GGGTTTCACCGTGTTAGCCAGGATGGTCTCGATCTCCTGACCTCGTGATCCTCCTGCCTCGGCCTCCCAAAGTGCTGGGATTACAG
GCGTGAGCACCGCGCCCGGCCGCAGTTCCTTTTTATAGCTGTTTGAATAGGAAAGATGACTTGGAAAATGCTGGATTCTGAGATTT
ATGTGCAGCCTTAAAAAGTGTAGTTTTTCTCTATCAATAATGAGTGTGGGTTGTAATTGCTTAGTAAGTAATTTTGTTTATGTAAA
CGTACATTTGTTAAATTTTTTTCTTAGGTAATCCCGTATGTTGGCACCATTCCCGATCAGCTGGATCCTGGAACTTTGATTGTGA
TATGTGGGCATGTTCCTAGTGACGCAGACAGGTAAAATCACTGTGCTAAAGGAAGGAGCATGAATAGGCTGTCTTTTTGTGATTGT
GGAATGATAACAGAGTAAGGCGGGAGAGACCATTTGATACTCTGAGGCCCAATTAGCTTTCATCAGCAGCCCTGGCCAAGGTGCTG
AGGAGATTGGAATGAATGACTAAATAAAGGTTATTGGGATTTATTTCATTGCTGTAAGTCTGATTTCAGTATAAAAAAATTAGAAC
TATCAGCTGGATGTGGTGACTTACACATACTTTTCCAGCACTTTGGGAGGCCAAGGCGGGAGGATTGTTTGAGGCCAGGAGTTCGA
GACCAGCCTGGGCAACATAGTGAGACCCCCCCCATCTGTTAAAAAAAAAAAAAAAAATTAAAAATTAACTGGGCTTGGTGGTGTG
CGCCCTGTAGTTGTAGCTACTCAGGGGGCTGAGGTAGGAGGATCCTTGAGCCAGGAGTTTGAGGTTGCAGTGAGCTGTGATGGAGCC
ACTGCACTATAGCCTGGGTGCAAAAAAAAAAAAAAAGAAAGAAAAAGAATTAGGTATGTCATTAAAGAA
AGGAATTGTGGTCAGATGACAGGGAGAGTCTAGTTTTAGTCTGACATTCCCACAGCATCCACAGATCTAGTTCAGATGGTTTTACTG
AATACTTGCTTTGGATACAAGCTGTGGTATCATTAGTGTTGGGCTCAGCTCTGTGTACCTAACACCTGAAGAGCAGTGGTTTAAGA
TGTGAAAATTAAGTCTCAAGGAGACAGCCCAGGCCTTTTCAGTTAACTCCTTCAAGTCGTTAGAGAAGTAGACTCCTTCCAGCTTA
CCACTCTGCTATCTTGAGGGTGAGGTGAGGTCCCCTTTCCCATTGCTGGCAGCTAGATTTCCAGCCCTCACTTCTGTGCTTTG
GGTAGCTGGATGGGTGCATGTGGTGTTTGCGGGGAAACAGAGCTGGACAAAAGGCAAGTGCTTGCTGACTTTTAAGGCAGTTTCTA
GTAGCCTTCCCTGAGCACTTCACTTCCATCTTATCAGCAGAGCTTTAGCTGCACAGGCAGGCCTAGCTGCAGGGAGGCTGGGAAA
GGTAGGTTTTATTCTGGGCAGATTCAGACCCAGTTCAAACTCAGGGGCTATTTTACTGAGGAAGACAGAAAAGATTAGACAGTCA
GCTCTTTAGGCCTCATAGTGAATGAATGAGGAGGGATTGGTACGTCCCTTGTCACTGGCTCTGGAGTGTAGTGCCTGCTGGGCCTT
TACTGGTGGCTTTCCTTTCTGAGCACTCATGAGGCCCCTGTGTCTTCCCTCATATAGATTCCAGGTGGATCTGCAGAATGGCAGCA
GTGTGAAACCTCGAGCCGATGTGGCCTTTCATTTCAATCCTCGTTTCAAAAGGGCCGGCTGCATTGTTTGCAATACTTTGATAAAT
GAAAAATGGGGACGGGAAGAGATCACCTATGACACGCCTTTCAAAAGAGAAAAGTCTTTTGAGATCGTGATTATGGTGCTAAAGGA
CAAATTCCAGGTAGGTTTTGGAGAGGGACAGGTTGAGTCCTCATTAGTGAGCAGGAGTGCACAGGGGGGCCTTTCGAACCCAGATGTCTCACATG
CCCAGCCTTGTATTTCCTACACCTGAGATATAGTTTGGCTTTGTAGTCTTTCTCCATAAAAGGAGCCAGGAAGGCACCTAAAATAT
GAGGGGGTGGCACCACTACTCTCCAGCCAGTTGTTGCCATGCAGAAATATGGTCCACTGTGACTAGATCTTTTTATTAGATCCTAT
TTCTCCTAGCAGGGCTGAGTTCTGAATTGACACAGTATTATGTTCATGATGGGAGGGTAAGTTATAATATAACCGTCACCACCTGA
AGAACTAACAAGGGCAATCCCAGCATAGAAATCAGAAGGGTTTTGTAAATTCAAGTCTTGCCACAAGACAGTTCTGTAGGATCATG
AGATTTTTAGACCCAGAGGACATCCTAGAAATCCTTGATGTCAGTTCCATCTCTGGCTTCATGGAGTGTCTTATACCTAGCGCGCG
TGTGTATGGTTGAATTTGGTCCCAGAAGCTCTTACACCTGCTGGCCCTCTGGCCTGTGGAGCTTTCCCACAGTAGAGGTTTGTACC
AACGTGAGAGAAGACTCACATGCCTCTGGCACAGATCCTTTCTGATCTTCGGGATACTGCTCCTGCCCGAAAGTCTTTCTGAATCT
CCCAAACTCCATTCACCTCTCCCTTCTCTGGCCTTTTGAGCCCGTGTCTGTATCATTCTTTTTCACAGTTTTTAACAGTTGTGCTT
TGGCTTTATGTGTTTATTTTGCCTCCACAATGGGATTTAAAGCTCCTTGAGTCAGAGACTATATTGTATGCTGCTCGCGTTTTCTG
CCTATAACCTAACGTGGTACCTGGCATTTGAGAGGGAGGGAGGGAGGGAGGCTCGTAGCGTGCCGAGGACCTGCAGAAGCTACTTTC
TCGTCATCTTACTGTAGTCTGTTGAGGTAGAGATTGTTCCTACTTCAGAATAAGAAAACCGAATTCAAATATGTTGGGTAACTTGT
CCATATTAATTTATTTAGCAAATACAACAGATTTTGAGTGTCTGCCACATGGGTGGTCTCCAGGGACAGTGTTGTGGGGAGCTCGC
AGGCAGATCTTTAACCTGGGTTCACAATCTCCAGGGCACCTGTGCCTGGGCTTCCAGGCGACCTTCGAACCCAGATGTCTCACATG
TATGCAGAGGCGCACACAAGCACACGCACATATACTTATGACTGCCTGTTTGTCTGGGGAGAGACAGTTCCTGGTGCTTAATCAAA
TCAGGAACTCAAAAGAAGTTCGGAAGCACTGCTGGTGTTTGGGTGCTTTCGGTTACCATTTGGTCACGTGTGTGGAGACCTGTGG
GAACAGGTATAAAATTGGACGCAAGGAAACATTTAAATTTGGATAATAAGTTAATTTATTAACTGTTTTTTTTTGGTGGCGGGGGG
GCTCGTCTTCTGTATCTCTCTAGGTGGCTGTAAATGGAAAACATACTCTGCTCTATGGCCACAGGATCGGCCCAGAGAAAATAGA
CACTCTGGGCATTTATGGCAAAGTGAATATTCACTCAATTGGTTTTAGCTTCAGCTCGGTGAGTGACCTTCCACAGCTTGGGGTCT
TTTATGAGGATGGTTTCTGATGAGATGGTAGAAAAAAATCTTCAAATAACACTTCTATTGACATAAAAAGGACGTATCTCCCTGACT
GTAGTATTAATTTTTGGAAGTGAACTGTTCACACTAGCAGAAGGCTGTTTATCAGCCAGGGCTTCATTGTCTGTAGGATCTCAAA
CCTAGTGTGGTTTTAATAAAACACACAGTTTTTAGCTGGCTGGGTAGCAGCTATTTCCTTTGCATGGGCATAAAATGGAGTATTTCTG
TAAGACAGGTTCCTAGGCTGGGAGTGTCTGAGTCAAAGAGCACAGTCATGTGTTGCATAAGGACAGTTCAGTCAAAGATGAACCGC
ATATACAACCGTGGTCCCATAAGATTGTCATATACTGTATTTTTACCATACCTTTTCTATGTTTAGGTAAGTTTATATGCACAAAT
ACTTACCATCCTGCTCTGGTTGCCTACAGTATTTGGTACAGTGCCTGCTGTACAGATTCACTGGCCAGGAGCTATAGGCCACACCC
TACAGCCTAGGTGTGTAGTTGGCAGTACCATCTAAGGTTGTTAAGTAATATTCTGTGATGTTGTCACGATGACAAAAGTCATGTAA
GGACACATTTCTCAGAACATACCCCCTTCGTTAAGCAACACATGACTGTCTTTGCATTGAAAATTTTGATAGATACTAACTCGCCC
TTCACAAGGGTAAAAACAGTTTGCACTCTCAACAGCCATGCTCCCACCTTCTTGTTGACATTACATCTTATTCTCTGTAATGTTTG
CCAATCTGATGGGGGCGGAAAGGACCCCCAGTGTCAAGTATATTTTGGATCATAGTTTTCAAGCATATTTTTAGTACCATTTAT
AATTTTTTATATGTCAAACAGGTTATATATAGAAAATATTTTCTACTGAGATTAACTTATTATCTTTTCTCAGGA
CTTACAAAGTACCCAAGCATCTAGTCTGGAACTGACAGAGATAAGTAGAGAAAATGTAAATATTAAATCTTTTAATGAGCCACTGG
TTTAAAAATGTTGTTTTAGCTGCCATGTTAATGAAATGGCAAGAAGGCTGGGTTTTTGAAAATTATGCTTTTAGAACGCAAGTAAT
CACTTGAAAATTGAGATACATACTTGTGGTGCCAGGCACGCAGTAAGTTTTGCTGATGATTCACCTGTCAGTTTCTGTAACTGCC
ACTCACTGTTCTTATGTAAAAAGCACTCTCTCACTCTTAACTGCTGAATAGTACTGTTCTGGGGTATTTCCAAATATTGAACATCA
GCCAGTGCACTGGCAAATGAACTTCCATGTGTATCTTCAACCCCTGGGAGAATAACTGCAATTTAAAAATGCGCTGTTATTAATGG
AGAAAGTGAGGTCTTACCGACTGGCACGTTCACACCTCACAGACAGAATAGAATCTTAGCATTCTGGGGGCACCCTGGAAAGGACA
ACTAAGACACGTTTGAAGTTCATGTAGTGCTGGGTGAAGGTGTGGCTCAGGCCTGTAGTCCCAGCGCTTTGGCTGAGGTGGGGGG
ATTGCTTGAGCCTAGGAGTTTGAGATCAGCCTGGGCCACATAGGGAGAACCCCATCTCTACAAAAAATTAAAAAATTATCTGGGCA
TGGTGGCGCATGGCTGTGATCCCAGCTTTGGGTGGCTGAAGTAGGCAGTGGACTTGAGCCCAGGAGGTTGAGGCTGCAGTGAGCCA
TGATTGAGCCACTGCATCCCAGTGTGGATGACAGAGTAAGACCCTGTCTCTTAAAAAAATTTCATATAGTTCTATGAAAATTATT
AATTTATGGTGGAGGATAAAGGACTCAGATGAACAGGGATATCAGACTCTCTTCTCAACCCGTGTAGCCCTTCACAACACCATACC
ATTCCGTCATAAAGCACCAGCTGCCTGGAGGTCACACCAGAGTGGAGCAGGAACATCCCAGGCTCCGGCCAGGCTCAGCTCAGCAC
AACCAAGACTTCAGATTATAAACTATAATTCTTCCCCTTCTAACATTGTTGTTTTGTTTCTTTTCCAATAGGTTCCAAAGTCTG
GCACGCCCAGCTTGTGAGTATTTTGCCTGGGTTATTTCATGTGGAATATTTTATAAAGTTGCATAGAAAATGAACAGTTTAAAC
CGTGGAGGGCAGCTTCATTCATTCCATTCCTTACTGTAGAACTGTTTCCCTACAGCCTAGTAATAGAGGAGGAGACATTTCTAAAA
TCGCACCCAGAACTGTCTACACCAAGAGCAAAGATTCGACTGTCAATCACACTTTGACTTGCACCAAAATACCACCTATGAACTAT
GTGTCAAAGGTTTGAAGAGCCCCAAATTTTCTTAACTCTGTATAAAAATTAAGTTGTAATGAGCTGTTACGAGTAACCTGTATCCA
CAATAGAAGCCCAAAGCAGCCCCCTCTGCATTTGTGTGCCGTCCCTGGATGGATTCGAGAGTCAACCAGGCCTGCCTCTGAGCCAT
TCCCTGTGTATTTCCTCAGCACCTCCCTGCTTGGCTGCTTCCCCTTCAGGCAGAACACAGTACTGCCTCAGACCCCAGGCACAGGG
GGCCTACCTGGCGTGTTTCACTCATACGAGGGCATCGGGTCCCACCCTGTCACTCATTTCATCGTCTAAAATGTAATCATGAGTG
TTTGCTTCGAGCCAGGGACAGTGCTGCTGCAGGGGACCCAGCTGGGACCAAGGCAGACTGTCTCTCCCCTCCTGGGATTTACAGGG
TCATGGCTCTGAAACATTCTGTAGTGTTGTTTGGACACGAGTTTTCCCTGGAGATCGCTTTCTGCAGGCCTCTTGGTCCTGACTGT
```

TABLE 1-continued

Sequences Table. First column: SEQ ID No. Second column: corresponding mRNA sequence. For the 3 different groups, see explanation in the text.

```
GGCTTCTTTTCAGAGCCTGCCATTCGCTGCAAGGTTGAACACCCCCATGGGCCCTGGACGAACTGTCGTCGTTAAAGGAGAAGTGA
ATGCAAATGCCAAAAGGTCAGTATCCTTCGGTACCAGTCACAGTGCAGATACTTCCGTGCCTGTTACCGCCTTCTACCCGTGAACG
GTCCTGTGAGCTGGAAGTAGGGCTAGTGTCAGAATCTTCATTTCCAAAGTGAGATGATTCAAGCAGGAGGTGGTTAGATTGTGAAC
AGCCAGTGGGCAGCAGAGCCGACTAAGGCCGTGTTCTGACCTCGGCTTTTTCTGGCCAGACAAGAGAGTAGCATTTTTGTCCACGA
GGCCTATCCTTGCCTTGTAGAACTCCAGAGCAGCCCCGTAAGATCAGGCAACATCTTTCTCTTTTTTTTTTTGAGATGGAGCCTC
ACTGTGTCACCCAGGCTGGAGTGCAGTGTCACAATCCCAGCACACCACAACCTCCGCTTCCTGGGTGTTCAAGCCATTCTCCTACC
TCAGCCTCTGGAGTAGCTGGGATTACAGGCGCACCACCACGCCCAGCTACTTTTTGAATTTTTGTATTTTTAGTAGAGACAGGGGT
TCACCATGTTGGCCAGGCTGGTCTGGAACTCCTGACCTCAAGTGATCCGCCCACTTCGCCCTCCCAGTGCTGGGATTACAGGTGTG
AGTCGCCACGCCCAGCCCAGGCAACATTTTTAGGGCCCCTCTTGTCATGTGATTTAGAAAATTTCTGCTTTAACAACTTTTTCCA
CAGACGTCCAGCCTTCTGAAAGCTTGAAATTAGAGCTATTTCCTAGAAAGTGGCATACTTTCAAGAAGGAAGGAACACGGGTAGAT
GATGAAAAGAGAATACCTGCTTGAGAGGATCCCAGGCTCCTGCAGCCTGAAGTAGTCATTCAGTTTAGCGTTAAACCTTCCATTTC
TGTCCAACCACATCTCAGCCTCAATGCTGATTTTAAAGGGGTTTTTTTTTCGTATTTTTATTTTGCAAGTAACGAATTAGTGGAA
TGCTGACTGGGTTTAAAATTTCAACTTCACCTGCATTCCCATGCTCCATGTGGATACGTGTGTTTCATAGAGTTAGAATCATAGTTC
AAGTCTGGTCACTAACATTGCTGAAATTGCCACTACTCTGTCCTACTTGGTTAATTAAGGTTTTTTTTTCTTTCTTTCTCAAAAGC
TTTAATGTTGACCTACTAGCAGGAAAATCAAAGGATATTGCTCTACACTTGAACCCACGCCTGAATATTAAAGCATTTGTAAGAAA
TTCTTTTCTTCAGGAGTCCTGGGGAGAAGAAGAGAGAAATATTACCTCTTTCCCATTTAGTCCTGGGATGTACTTTGAGGTGAGGT
TCCAGTTTTTGAAAATGGGACAGCAATAAGAATCCTGGGAGCAGGGGTGGGATAAGTGGTCCATTTAAATCAAGTCCTAACTCAGT
ATGTGGAGGTTGTGTATGTTTTTTGTTTACTTGGAGATTGTAATTTGCCCCTTCCTTTTTATAACGTGGGCAATCAGTATAAATGG
CAAAGCCAGTAGAGTGTCAAATTATGCACATTGGAATTGACATTTGTCATCATATTAAAATTCCTGTGTAGCCCATATTGATAGGA
TTTACCAGGAAGCTTGTCTCAGGACTGGAGTCACACATTTAATCATATAAGCAGACTTGAGGACTGGAGACCCTAAAACTGCTTGC
TTGCACTGGCCATCATCTCCCATCAGGGTAGGTGGCAGTCCTTTCTCCTAAGGAGTTAGTCTTGTTTTATATGTATTCAAGGAAAAA
TACATCAGTCCCTTGGAACTAAAAGGCATGCAGTCCTGAGTCCCCAGATAGGTGAATATTGTAACACATACCTTTCCCGAAATATG
TTTCTGGGATGCTGAGCAGAGAATAGTCTTCCTTGTGATGTGGATGCCGGGTGTTTGGCCAGCCTCAATCACCAGCTCAGGTGCCAC
TGCCTCACACAGTCACTTAGGGTCATTGGTTTAGGTTATCATTCTACAGCATTTTAAACTGACACATTGTCTGGACCATGTGGGTT
CTTGAGGACTCATCAAAACCCGTTACTAAAAGCATGAATATCAGGCGAAATAGATTGACAATGTGACATTCGTATTTATCCCTAAGT
TCCAGTCTAATGCAGTGCCCTGGTATGTGGAGTGTAGACAGATGTGGGCTAATCATGGAAGGTTCCCTGGGAAGTTGTGGATATTG
GTTTCGGAATTCAGAAAGCTGGGAAGGATGTGGAAGGCTGAAGGTTGGCTTTTCTAGATTTAGGGCATGATTTGAACAAGTCCTTA
GAGGTGGGAAGGGCAGCACAGGGTTGTTGGCTTGGCAAGAGTCAAGGTGCAAAGGGTGACTTGGGGTTCACTGGAGGGAAACAGAG
ATGAGTGCTCTAGAAGGAAGTTGAGCCTTGTGGTGGGTGACAGGAAACCAATGATGTAACTTGTTTTTGACCTATCTGGGCCCCAA
GTTTGGATCTGCTATATTAATATAAAAAAGGATAATAATGATACATTCAAATAATGCTGAAAAATACTAAGATGAAAATACCTCCA
ACTTCGTAATTCAAACCATACCATTAGGATTAGGTGAACCACATTCCAGGCGTTTTTTGCAGAGACAGTGAAAGGGATGGCTGGC
TGAAGGAATGAATAGATGAATGTTATATGCTTTTGAACAATCGTCTTTTCCATTTAATTTTCTAATTCAGGAGCAGTAATTATCCT
TGTGTTGATCACTGCTGACGATTTTCTATACTGATAGGTCCTTTCCGGGGGGCTTCCATCTCTTGCCTTTTAAATATGCTTGCATT
GAGATTATCTCAGGTCTTTCCATTATGCCATTACTTTCATTTTAAATCTTCTTGCTCTTTCAAATACACTTTAGTTGTATCTACAG
TGTTTTAAAAACAATCTCATTCAGTGTTGTAATTTCATCTGTGGGCTCTTCCTCTGGATGAAATCCGTGTTCCTCCCAGCTGTTCG
GCAGCATCAGATGGTTGTGAGGGATTCTGTTGTTCTGTTTTCTTCAGGCAAAGGATGTGCCTTCTTTTCATTTGCAGTAGTCTGC
TCACCCGGAAGCATGTCATTTCTTTGCCACTTGCTTGTAATTCACTGGCTTTGCACTTGCTCTGATACAGTACAGGTAACTAATTG
ACTCCTCTGCTGCCAACTTTGGTTTTCCTTCTGAGCTATAGCATCAGGCTGTGTGTTTTGTGTTTTCTTGAGATTTTGTTAAGTAT
ATCTGGGGTCCCTCTACCTGGTTGGAACTGGGATTCCCACCATTCTTGTGGGGATAGAATCTCAGGTACACCTATTTCCCCAATC
CTCTGTAGCCACAGAAGCTTCATCTTGGCCAGCTCTGTTATCAGAGTGCAGGACTTGGGCTGAAATTTCCTCCCCTTCCTGATTTT
CCTTGACAGTCCTTTCCACTGCTCCTATCAATCAAAAGAATGAAAACCCTCAACTTGCTGCTTTGCAGATTCAGGTTTTGTGCTTC
TTTCTGCCTCTCGGGGTGGGGCCGGGTTAGCAGCAAGGCTGAGCTGCCCCTCTTTGTTCTGAAGCCTTCATGGGGGCGAGGAGCA
CAGGGAGAGCTCAGTGCAGGGCCTCCCAGTGGCCTTCTCAGAGTGGGTGGAAACCCAGCCTGGCACTGGCAGCGTGGCACCAGAAG
TATGAAGTGTAGGTGTAAAGGTGATGTAAAAGGCTAGTAGGTTTTTGGTTTTTCGTTGTTTGAGTTTGGGCATAGATGACTGTG
AAGGGCGAACACTGCCGATGGATCTGAATGAATTTGTAGTATGTGCACCACTTCCGACTTACGGGATACCCAGCTTTGACGGCTTT
GGACAAACACACTGAGGCCAAGATGTGCTGAGCTTATCAGGATCAGGATCACCAAGCAGCTGTAAAAACCCTAGCAAGTGCCTTAA
GCTGCTGAAATTTCATATTTAATTGTCTGGTTTGTTCATGGTCCTAGAGTTTGAGGCAGAAAAGTCAGGATCCAAGTCCCTTGGTTC
CAGGCTACAGCTGGAAACAGCATCTCGGTGAACTAAAGCAACCATATTAGGAGTTTTCCTGCTTTAGGAGAGTCCCCAGCATCGGC
GAGGAGGGGGCAGCACTCTGGCTTTCCAGGAGCAAGGGGCAGGATGCGGCCGAGGGAGAGGGGCTGTGTTGAGGAAAGGAGGGCCG
CAGGCCCTGGGGATGGTGTGAGGCTCCAAACATGTCCGAGTCACTTCCCTGGGTGGGATGGGGCAGACAGTGCCACCACCAGGGAC
ACTTTAGTTGATTAGGGTCTTGGAAGTCACAGAAGGAAGTCAGCAGCAGCAGGCTGGAACTTTTCTATGTATAATCAAATGGTTT
ACTCTGACACCGTTAGCATGTAACAAACACAAAATTTTAAACTAAGGGGAACCACTAATGGCATGTTTCCTTTCCTTTCAGATGAT
AATTTACTGTGATGTTAGAGAATTCAAGGTTGCAGTAAATGGCGTACACAGCCTGGAGTACAAACACAGATTTAAAGAGCTCAGCA
GTATTGACACGCTGGAAATTAATGGAGACATCCACTTACTGGAGAAGGTGGTAGCCTACCTACACAGCTGCTACAAAAACC
AAAATACAGAATGGCTTCTGTGATACTGGCCTTGCTGAAACGCATCTCACTGTCATTCTATTGTTTATATTGTTAAAATGAGCTTG
TGCACCATTAGATCCTGCTGGGTGTTCTCAGTCCTTGCCATGAAGTATGGTGGTGTCTAGCACTGAATGGGGAAACTGGGGCAGC
AACACTTATAGCCAGTTAAAGCCACTCTGCCCTCTCTCCTACTTTGGCTGACTCTTCAAGAATGCCATTCAACAAGTATTTATGGA
GTACCTACTATATACAGTAGCTAACATGTATTGAGCACAGATTTTTTTGGTAAAACTGTGAGGAGCTAGGATATATACTTGGTG
AAACAAACCAGTATGTTCCCTGTTCTCTTGAGCTTCGACTCTTCTGTGCTCTAAGTAGTGCGCACTGCTTTTTCTACAGGCATTAC
ATCAATCCTAAGGGGTCCTCTGGGATTAGTTAAGCAGCTATTAAATCACCCGAAGACACTAATTTACAGAAGACACAACTCCTTC
CCCAGTGATCACTGTCATAACCAGTGCTCTACCGTATCCCATCACTGAGGACTGATGTTGACTGACATCATTTTATCGTAATAAAC
ATGTGGCTCTATTAGCTGCAAGCTTTACCAAGTAATTGGCATGACATTTGAGCACAGAATTAAGGCAAAAAACCAAAGCAAAACA
AATACATGGTGCTGAAATTAACTTGATGCCAAGCCCAAGGCAGCTGATTTCTGTGTATTTGAACTTAGGGCAAATCAGATCTACA
CAGACGCCTACAGAAGTTTCAGGAAGAGGCAAGATGCATTCAATTTGAAAGATATTTATGGGCAACAAAGTAAGGTCAGGATTAG
ACTTCAGGCATTCATAAGGCAGGCACTATCAGAAAGTGTACGCAACTAAGGGACCCACAAAGCAGGCAGAGGTAATGCAGAAATC
TGTTTTGTTCCCATGAAATCACCAATCAAGGGCCTCCGTTCTTCTAAAGATTAGTCCATCATCATTAGCAACTGAGATCAAAGCAC
TCTTCCACTTTACGTGATTAAAATCAAACCTGATTCAGCAAGTTAAATGGTTCCATTTCTGTGATTTTCTATTATTTGAGGGGAG
TTGGCAGAAGTTCCATGTATATGGGATCTTTACAGGTCAGATCTTGTTACAGGAAATTTCAAAGGTTTGGGAGTGGGAGGGAAAA
AAGCTCAGTCAGTGAGGATCATTTTATCACATTAGACTGGGGCAGAACTCTGCCAGGATTTAGGAATATTTTGAGAACAGATTTTA
GATATTATTTCTATCCATATATTGAAAAGAATACCATTGTCAATCTTATTTTTAAAGTACTCAGTGTAGAAATTGCTAGCCCTT
AATTCTTTTCCAGCTTTTCATATTAATGTATGCAGAGTCTCACCAAGCTCAAAGACACTGGTTGGGGGTGGAGGGTGCCAGGGA
AAGCTGTAGAAGGCAAGAAGACTCGAGAATCCCCAGAGTTATTTTTCCCATAAAGACCATCAGAGTGCTTAACTGAGCTGTTGG
AGACTGTGAGGCATTTAGGAAAAAAATAGCCCACTCACATCATTCCTTGTAAGTCTTAAGTTCATTTTCATTTTACGTGGAGGAAA
AAAATTTAAAAAGCTATTAGTATTTATTAATGAATTTTACTGAGACATTTCTTAGAAATATGCACTTCTATACTAGCAAGCTCTGT
CTCTAAAATGCAAGTTGGCCTTTTGCTTGCCACATTTCTGCATTAAACTTCTATATTAGCTTCAAAGGCTTTTAAACTCAATGCGA
ACATTCTACGGGATGTTCTTAGATGCCTTTAAAAAGGGGGCAAGATCTAATTTATTTGAACCCTCACTTTCCAACTTCACCATGA
```

TABLE 1-continued

Sequences Table. First column: SEQ ID No. Second column: corresponding mRNA sequence. For the 3 different groups, see explanation in the text.

CCCAGTACTAGAGATTAGGGCACTTCAAAGCATTGAAAAAAATCTACTGATACTTACTTTCTTAGACAAGTAGTTCTTAGTTAACC
ACCAATGGAACTGGGTTCATTCTGAATCCTGGAGGAGCTTCCTCGTGCCACCCAGTGTTTCTGGGCCCTCTGTGTGAGCAGCCAGG
TATGAGCTGTTTTAGAAGCAGCGTGTTGCCTTCATCTCTCCCGTTTCCCAAAAGAACAAAGGATAAAGGTGACAGTCACACTCCTG
GGTTAAAAAAAGCATTCCAGAACCACTTCTCTTTATGGGCACAACAAAAGAAACGAAGGCTGAAGTTCGCCTACCCAAAATGAAAAG
TAGGCTTTACAGTCAAAAGTACTTCTGTTGATTGCTAAATAACTTCATTTTCTTGAAATAGAGCAACTTTGAGTGAAATCTGCAAC
ATGGATACCATGTATATAAGATACTGCTGTACAGAGAGTTAAGGCTTACAGTGCAAATGAGGCGTCAGCTTTGGGTGCTAAAATT
AACAAGTCTAATATTATTACCATCAATCAGGAAGAGAATAATAAATGTTTAAACAAACACAGCAGTCTGTATAAAAATACCGTGTA
TCATTTACTCTTTCTGCAGCTCTATACGATAGGCAGGAGAGGCTTATGTGGCAGCACAAGCCAGGTGGGGATTTTGTAACGAAGTG
ATAAAACATTTGTAAGTAATCCAAGTAGGTGTATTAAGGCACCAAAAGTAACATGGCACCCAACACCCAAAAATAAAAATATGAAA
TATGAGTGTGAACTCTGAGTAGAGTATGAAACACCACAGAAAGTCTTAGAAATAGCTCTGGAGTGGCTCTCCCAGGACAGTTTCCA
GTTGCTGAATAGTCTTTTGGCACTGATGTTCTACTTCTTCACATTCATCTAAAAAAAAAAAAAAAAAAATCAAATTAAAATCTG
AGTCAGTCTGCCTGCCTCGGTTCTCATTAGTTTAATTCTTAATGCCTTGCACTTTCCAGCAATCATTCAATCAAAGAGTGAAATG
AAGCACATTAACAAAGCAGGAGGCGCCACGGACCGCCTCCCTCCACACCGCTCCTTCCGACCTTCATTCCTTGCCCACAGGCTTGCA
CTGGAAGCTGAATAAGAATCCCCAAAACTCAAACTTCCTAGGGATGCCACCCCTTTAGTAGCTCACACCTCCCCCCTCCAAGAGCT
AAGAACAAAGGAGAATGTACTTTTGTAGCTTAGATAAGCAATGAATCAGTAAAGGACTGATCTACTTGCTCCACCACCCCTCCCT
TAATAATAACATTTACTGTTATTTCCTGGGCCTAAGACTTATGTTCCAGAACTGTCACAGCTCCCATGTCACACCCACTAGCTTG
TGATCTTTGTCAAATAACTGAAATCTTTTAAGCCTCTAGTTTCTTCCTTTGTAAAACAGAATAAAATGTTGTGGTTTTTAAGTGA
GATAATCCAAGTAAAGCACCTAACATGGAGTAGTGAATGAACATCGGTTGCTACTAAAAGTGGACATCCTACCGCATCCTTAATGC
CACTAGGCATTTCCATACAATCTGGGGACCAAAACTTCAATCATATAAATGTATGAGGTTAATTAAAAACACTACTGTAATCTGCT
TGTATGATCACAAACCACCACAAAAGAAAAGATCGTGAAGATTACACTGTAAACGGACTCTCAAATGATCAGGAGGTGGTCACTTC
GCAACTTGCTCCCTCCACCCAACTCAAAACAGGAGCTCGAGCCTGCCTGTATTGAGACTGGAGCTGCCTGTATGAGGACTGGATC
AACTGCTAGTCACGTTATATCCAAATCTGCATTATCATTGGGCACATTTTCACAGAATTTTACTGAATTATTCCTTAATTGTTTAA
TGGTTGGGAATAGTTTGGGAATTACCTTCCATCAACTCTGCTAAGAAAGGAATGGATTCTGGTAGCAAGACAATATAATTCTCCTT
TAGTTTTTCAGCCAGTGCTAACACAGTAATCAAAGCAGCAAATCGAACCTGAAAGGGATAAAAGAGCAAAGAAATAAAAAGTAGTG
TTACTGTATTTATTATCTTAAGAGCTGTACTGACTTGAGACAAGGCTCTAACTTTTTAAACATTAGTTCACACGCGTTTATTCACTT
CATTATGTTCATTAAGCTTTCATCTTAGAATACCAGTTTCACCATTTGGGAGCTGTTTGTAATATGTGCAACCTTATAAATAGTGT
TTTCCAAACTGTGTCCCAGGACTGCAAATCTTTAATGTGAAATGTCTTTTTATAATCTCTTCCTTTAAAAAAAAACCAATAAAATAA
AATGCCACATGCAAACTCAAGTGTGTCACCAGATTTTACTTCATTGGCGCTCGCCAGCCCGCCAGGCTGGCAATAAAGTGCCTCCA
GCCACCTCTGGCAGGTCTCCTCACCCACAGCCCCTGACTGGTCACCACTATAGTTGTATGAGGGGCCAGGACAATCGCTTGGGATA
AACTCCCATCTCAGCACTGAATAAAAAACATTCTGTGTCACAATATCCTAGTTTTGGGGCTTTAAAAACGTCTAGGTGTTCCTCAC
ATGCCTTGTCTATAATAAGGAAAGCAAGCAGTAGTTGGGTATTGTTAGCTTTTGAAACAAAAGCCCTACTGGTCTTCTAATTTTGG
ATATTTTAATTAAAGAATATCTGGACAGTACAAAGTGAATTATTAAAAAACCATTTGTAACTACCTAGATTCAATCAGGATTTCCT
TGATTTGTGCAAAGTAAAATATTACAATAAATTTGATACTGCTACTTGTATAAAAACCTATGGTTTAAAATGTGGGGGTCATCAT
AATAGTCTCATTGTTAGCATATCCTAATAAAGAATTTGAACTAATAAATCCTATTAATAAAATTCTGCTTTGGTCTGTTATAGCCA
GTAAAGTTCTAATACAATCATTAGTTTGAGAAATGGTGACTCATTGCTAAAACAGTTTGAAATTTGTA

53 AAAAACTTATTAGAGCTTTCTCAACCTGCAGCCCTCATCTCCGCCGGCGAGTAGGGCCAGGTGTTGGGAGCTCCCACGTGGGACAA
GATGGTGTCTTCGGCGCAGATGGGCTTCAACCTGCAGGCTCTCCTGGAGCTCTCCAGCCAGGATGAGTTGAGCAAGTTCAAGTATC
TGATCACGACCTTCTCCCTGGCACACGAGCTCCAGAAGATCCCCCACAAGGAGGTAGACAAGGCTGATGGGAAGCAACTGGTAGAA
ATCCTCACCACCCATTGTGACAGCTACTGGGTGGAGATGGCGAGCCTCCAGGTCTTTGAAAAGATGCACCGAATGGATCTGTCTGA
GAGAGCAAAGGATGAAGTCAGAGAAGCAGCTTTGAAATCCTTTAATAAAAGGAAACCTCTATCATTAGGGATAACACGGAAAGAAC
GACCACCTCTAGACGTGGACGAAATGCTGGAGCGCTTCAAAACAGAAGCACAAGCGTTTACAGAAACGAAAGGAAAATGTCATCTGC
CTGGGTAAAGAAGTCTTTAAAGGAAAAAAGCCAGACAAAGACAATAGGTGCAGGTATATATTGAAGACGAAGTTCGGGAGATGTG
GAAGAGCTGGCCTGGAGATAGCAAAGAGGTCCAGGTTATGGCTGAGAGATACAAGATGCTGATCCCATTCAGCAACCCCAGGGTGC
TTCCCGGGCCCTTCTCATACACGGTGGTGCTGTATGGTCCTGCAGGCCTTGGGAAAACCACGCTGGCCCAGAAACTAATGCTAGAC
TGGGCAGAGGACAACCTGATCTACATAAGGGTGGAGGATGTCCTGAATGCAGGAGCTCAGCCGCCTGGGCCCGTGCAGTTT
TGCAGAGCTGGTCTTCAGGGACTGGCCTGAATTGCAGGATGACATTCCACACATCCTAGCCCAAGCACGGAAAATCTTGTTCGTGA
TTGACGGCTTTGATGAGCTGGGAGCCGCACCTGGGGCGCTGATCGAGGACATCTGCGGGGACTGGGAGAAGAAGAAGCCGGTGCCC
GTCCTCCTGGGGAGTTTGCTGAACAGGGTGATGTTACCCAAGGCCGCCCTGCTGGTCACCACGCGGCCCAGGGCCCTGAGGGACCT
CCGGATCCTGGCGGAGGAGCCGATCTACATAAGGGTGGAGGAAGGACAGGAGGGCCTATTTCCTGAGACACTTTG
GAGACGAGGACCAAGCCATGCGTGCCTTTGAGCTAATGAGGAGCAACGCGGCCCTGTTCCAGCTGGGCTCGGCCCCCGCGGTGTGC
TGGATCGTGTGCACGACTCTGAAGCTGCAGATGAGAAGGGGGAGGACCCGGTCCCCACCTGCCTCACCCGCACGGGGTGTTCCT
GCGTTTCCTCTGCAGCCGGTTCCCGCAGGGCGCACAGCTGCGGGGCGCGCTGCGGACGCTGAGCCTCCTGGCCGCGCAGGGCCTGT
GGGCGCAGACGTCCGTGCTTCACCGAGAGGATCTGGAAAGGCTGCAGGAGTCCGACTCCTCGTCTGTTCCTGGACGGAGAC
ATCCTCCGCCAGGACAGAGTCTCCAAAGGCTGCTACTCCTTCATCCACCTCAGCTTCCAGCAGTTTCTCACTGCCCTGTTCTACAC
CCTGGAGAAGGAGGAGGAAGAGGATAGGGACGGCCACACCTGGGACATTGGGGACTACAGAAGCTGCTTTCCGGAGTAGAAAGAC
TCAGGAACCCCGACCTGATCCAAGCAGGCTACTACTCCTTTGGCCTCGCTAACGAGAAGAGAGCCAAGGAGTTGGAGGCCACTTTT
GGCTGCCGGATGTCACCGGACATCAAACAGGAATTGCTGCGATGCGACATAAGTTGTAAGGGTGGACATTCAACGGTGACAGACCT
GCAGGAGCTCCTCGGCTGTCTGTCAGTCTCAGGAGGAGGACTGGTGACGAGGGTGATGGCTCAGTTCAAAGAAATATCCCTGC
ACTTAAATGCAGTAGACGTTGTGCCATCTTCATTCTGCGTCAAGCACTGTCGAAACCTGCAGAAAATGTCACTGCAGGTAATAAAG
GAGAATCTCCCGGAGAATGTCACTGCGTCTGAATCAGACGCCGAGGTTGAGAGATCCCAGGATGATCAGCACATGCTTCCTTTCTG
GACGGACCTTTGTTCCATATTTGGATCAAATAAGGATCTGATGGGTCTAGCAATCAATGATAGCTTTCTCAGTGCCTCCCTAGTAA
GGATCCTGTGTGAACAAATAGCCTCTGACACCTGTCATCTCCAGAGAGTGGTGTTCAAAAACATTTCCCCAGCTGATGCTCATCGG
AACCTCTGCCTAGCTCTTCGAGGTCACAAGACTGTAACGTATCTGACCCTTCAAGGCAATGACCAGGATGATATGTTCCCGCATT
GTGTGAGGTCTTGAGACATCCAGAATGTAACTGCGATATCTCGGGTTGGTGTCTTGTTCCGCTACCACTCAGCAGTGGGCTGATC
TCTCCTTGGCCCTTGAAGTCAACCAGTCCCTGACGTGCGTAAACCTCTCCGACAATGAGCTTCTGGATGAGGGTGCTAAGTTGCTG
TACACAACTTTGAGACACCCCAAGTGCTTTCTGCAGAGGTTGTCGTTGGAAAACTGTCACCTTACAGAAGCCAATTGCAAGGACCTT
TGCTGCTGTGTTGGTTGTCAGCCGGGAGCTGACACACCTGTGCTTGGCCAAGAACCCCATTGGGAATACAGGGGTGAAGTTCTGT
GTGAGGGCTTGAGGTACCCGAGTGTAAACTGCAGACCTTTGGTGCTTTGGACTGCACAATAACTAGCGATGGCTGCGATCTC
ACAAAGCTTCTCCAAGAAAAATCAAGCCTGTTGTGTTTGGATCTGGGGCTGAATCACATAGGAGTTAAGGGAATGAAGTTCCTGTG
TGAGGCTTTGAGGAAACCACTGTGCAACTTGAGATGTCTGTGGTTGTGGGGATGTTCCATCCCTCCGTTCAGTTGTGAAGACCTCT
GCTCTGCCCTCAGCTGCAACCAGAGCCTCGTCACTCTGGACCTGGGTCAGAATCCCTTGGGGTCTAGTGGAGTGAAGATGCTGTTT
GAAACCTTGACATGTTCCAGTGGCACCCTCCGGACACTCAGGTTGAAAATAGATGACTTTAATGATGAACTCAATAAGCTGCTGGA
AGAAATAGAAGAAAAAAACCCACAACTGATTATTGATACTGAGAAACATCATCCCTGGGCAGAAAGGCCTTCTTCTCATGACTTCA
TGATCTGAATCCCCCCGAGTCATTCATTCTCCATGAAGTCATCGATTTTCCAGGTGTTGGTGAACTGCCTGTGACTCCTCTCCTCC

TABLE 1-continued

Sequences Table. First column: SEQ ID No. Second column: corresponding mRNA sequence. For the 3 different groups, see explanation in the text.

CCGGCCCCTACCCCTCAGGGATAATGAGTTCATTGCTGGGCTAGATGTTTTAGCCATGATTCTGCCTCTGTTTTATACCTGCACAC
ATCCTTATCTTTGTTACATATGAAATATCTGTATCACGGGTATATTGAGAGAAATAAAGGTGAGAGCATTCACAAAAAAAAAAAA
AAAAA

54 CCGAGCGCCAGCGCGGGGAACCGGGAAAAGGAAACCGTGTTGTGTACGTAAGATTCAGGAAACGAAACCAGGAGCCGCGGGTGTTG
GCGCAAAGGTTACTCCCAGACCCTTTTCCGGCTGACTTCTGAGAAGGTTGCGCACAGCTGTGCCCGGCAGTCTAGAGGCGCAGAAG
AGGAAGCCATCGCCTGGCCCCGGCTCTCTGGACCTTGTCTCGCTCGGGAGCGGAAACAGCGGCAGCCAGAGAACTGTTTTAATCAT
GGACAAACAAAACTCACAGATGAATGCTTCTCACCCGGAAACAAACTTGCCAGTTGGGTATCCTCCTCAGTATCCACCGACAGCAT
TCCAAGGACCTCCAGGATATAGTGGCTACCCTGGGCCCCAGGTCAGCTACCCACCCCCACCAGCCGGCCATTCAGGTCCTGGCCCA
GCTGGCTTTCCTGTCCCAAATCAGCCAGTGTATAATCAGCCAGTATATAATCAGCCAGTTGGAGCTGCAGGGGTACCATGGATGCC
AGCGCCACAGCCTCCATTAAACTGTCCACCTGGATTAGAATATTTAAGTCAGATAGATCAGATACTGATTCATCAGCAAATTGAAC
TTCTGGAAGTTTTAACAGGTTTTGAAACTAATAACAAATATGAAATTAAGAACAGCTTTGGACAGAGGGTTTACTTTGCAGCGGAA
GATACTGATTGCTGTACCCGAAATTGCTGTGGGCCATCTAGACCTTTTACCTTGAGGATTATTGATAATATGGGTCAAGAAGTCAT
AACTCTGGAGAGACCACTAAGATGTAGCAGCTGTTGTTGTCCCTGCTGCCTTCAGGAGATAGAAATCCAAGCTCCTCCTGGTGTAC
CAATAGGTTATGTTATTCAGACTGGCACCCATGTCTACCAAAGTTTACAATTCAAAATGAGAAAAGAGAGGATGTACTAAAAATA
AGTGGTCCATGTGTTGTGTGCAGCTGTTGTGGAGATGTTGATTTTGAGATTAAATCTCTTGATGAACAGTGTGTGGTTGGCAAAAT
TTCCAAGCACTGGACTGGAATTTTGAGAGAGGCATTTACAGACGCTGATAACTTTGAACTCAGTTCCCTTTAGACCTTGATGTTA
AAATGAAAGCTGTAATGATTGGTGCCTGTTTCCTCATTGACTTCATGTTTTTTGAAAGCACTGGCAGCCAGGAACAAAATCAGGA
GTGTGGTAGTGGATTAGTGAAAGTCTCCTCAGGAAATCTGAAGTCTGTATATTGATTGAGACTATCTAAACTCATACCTGTATGAA
TTAAGCTGTAAGGCCTGTAGCTCTGGTTGTATACTTTTGCTTTTCAAATTATAGTTTATCTTCTGTATAACTGATTTATAAAGGTT
TTTGTACATTTTTTAATACTCATTGTCAATTTGAGAAAAAGGACATATAGATTTTTGCATTTATTAATGAAACTTCCTTTGAAAAA
CTGCTTTGAATTATGATCTCTGATTCATTGTCCATTTTACTACCAAATATTAACTAAGGCCTTATTAATTTTTATATAAATTATAT
CTTGTCCTATTAAATCTAGTTACAATTTATTTCATGCATAAGAGCTAATGTTATTTTGCAAATGCCATATATTCAAAAAAGCTCAA
AGATAATTTTCTTTACTATTATGTTCAAATAATATTCAATATGCATATTATCTTTAAAAAGTTAAATGTTTTTTAATCTTCAAGA
AATCATGCTACACTTAACTTCTCCTAGAAGCTAATCTATACCATAATATTTTCATATTCACAAGATATTAAATTACCAATTTTCAA
ATTATTGTTAGTAAAGAACAAAATGATTCTCTCCCAAAGAAAGACACATTTTAAATACTCCTTCACTCTAAAACTCTGGTATTATA
ACTTTTGAAAGTTAATATTTCTACATGAAATGTTTAGCTCTTACACTCTATCCTTCCTAGAAAATGGTAATTGAGATTACTCAGAT
ATTAATTAAATACAATATCATATATATATTCACAGAGTATAAACCTAAATAATGATCTATTAGATTCAAATATTTGAAATAAAAAC
TTGATTTTTTGT

55 CGCTGCTGGGCGGCGGCAGGGTGGCGGACGGAGCGGGGGACCGGGGAGCGGCGGCCGCGAGGAGGTTATGTTTGTGTTTGGGGTTG
TCAAGTGAAGGAGGGATCCCAGGCGCCGCCGCCGCCGCGGGGGTCGCGAGATCCCGAGCCGCGGCCGCCGCCATCAGCAGCGC
AGTCCAGGGCCGGCTGCAGCGGCAGCTCCGCCGGGCGTCCTGGCAGCAGCACATGGATTAATTGATGTATGTTGAGTTTATGGAGC
TGCCTTTTGGTGGCTTGCTTTATCTGCAGTTTTTAAGAAGAAAAAGAAGGCCCTGAGTCAAAGAAGATGCCTCGAACTAAACAAT
TCATCCCAGAAATCTAAGAGACAAAATTGAAGAAGCACAAAAAGAACTTAATGGGGCAGAAGTTTCAAAAAAGAAATCTTACAGG
CTGGTGTTAAAGGAACTTCGGAATCCCTTAAAGGTGTGAAACGCAAAAAGATCGTAGCTGAGAATCACCTGAAAAAAATACCAAAA
TCCCCACTGAGAAATCCTCTTCAGGCAAAACATAAACAAATACAGAAGAGTCATCTTTCGCCGTTCTTCATAGTGCTTCGGAGTC
TCACAAGAAACAGAATTATATTCCTGTAAAAAATGGGAAGCAGTTTACCAAACAAAATGGAGAAACACCTGGAATAATTGCTGAAG
CCTCAAAATCTGAAGAATCTGTCTCCCCAAAGAAGCCCTTGTTTCTGCAGCAACCATCTGAACTGCGTAGATGGAGATCCGAAGGC
GCTGATCCTGCCAAATTCAGTGACCTCGATGAACAATGTGACTCAAGTTCCTTGTCAAGTAAAACCAGGACTGACAATAGCGAATG
CATCTCTTCTCATTGTGGCACTACGTCCCCCTCCTATACAAACACTGCATTCGATGTCTTACTGAAAGCAATGGAGCCAGAACTGA
GCACCTTGTCACAAAAGGGCTCACCTTGTGCAATTAAGACAGAAAAACTGAGGCCAAATAAAACTGCACGTTCCCCTCCCAAATTA
AAAAACAGTTCAATGGATGCCCCAAATCAGACTTCACAGGAATTGGTTGCTGAATCACAGTCTTCTTGTACCTCATACAGTCCA
TATGTCTGCTGCTCAGAAGAATGAGCAAGGGCAATGCAGTCAGCTTCTCATTTGTATCATCAACATGAACACTTTGTTCCCAAAT
CCAACCAACATAATCAACAGCTTCCGGGGTGTTCAGGTTTCACAGGATCACTGACAAATCTGCAAAATCAAGAGAATGCCAAACTT
GAACAGGTTTATAATAGACGTGACATCATCTGTAGGCCTAACTTCACCTTCCAGTAGATCTCAGGTTACTCCTCAAAACCAGCA
AATGGATTCTGCTTCACCTTTGTCAATAAGTCCGGCTAATTCTACACAGTCGCCCCCCATGCCAATCTATAATTCAACTCATGTTG
CCTCTGTTGTTAATCAAAGCGTAGAGCAAATGTGCAATCTTCTTCTGAAAGATCAGAAGCCAAAAAACAAGGAAAATATATTTGT
GAGTATTGCAATAGAGCATGTGCAAAGCCTAGTGTGCTTTTAAAGCATATCCGCTCCCACACTGGAGAGCGACCCTATCCCTGTGT
GACTTGTGGATTTTCATTTAAGACTAAAAGTAATCTGTATAAGCACAAGAAAATCCCACGCACATACTATCAAACTGGGTCTTGTCT
TGCAACCAGATGCTGGTGGCTTGTTCTTGTCCCACGAGTCCCCCAAAGCACTTAGTATTCATTCAGACGTAGAAGACAGTGGGGAG
AGCGAGGAGGAAGGCGCCACTGATGAGAGACAGCATGACCTGGGCGCCATGGAGCTGCAGAATGTGCACATAATAAAGAGGATGTC
AAATGCTGAAACTTTACTAAAATCAACCTTCACTCCAAGCAGTCCAGAAAATGTGATAGGTGACTTTTTGCTACAGGACAGATCTG
CAGAATCACAAGCTGTGACAGAGTTACCGAAAGTTGTGGTCCACCATGTCACTGTGTCCCCCTTAAGAACTGACAGTCCAAAGGCC
ATGGATCCCAAGCCTGAACTTTCTAGTGCACAAAAGCAGAAGGACCTTCAGGTGACAAACGTACAGCCACTTTCAGCCAACATGTC
CCAGGGTGGAGTCTCCAGGTTGGAGACTAATGAGAATTCCCACCAGAAAGGCGACATGAATCCACTGGAAGGAAAGCAAGACTCTC
ACGTAGGAACGGTACACGCCCAGCTACAAAGGCAGCAGGCTACCGATTACTCCCAAGAGCAGCAAGGAAAGCTCCTGAGTCCTCGA
AGTTTAGGAAGTACGGATTCTGGTTACTTTTCACGTTCTGAAAGTGCCGATCAAACAGTGAGTCCACCAACTCCCTTTGCCAGAAG
GTTCCCAGCACAGAACAAGACTCTGGAAGGAGTAACGGACCCTCTGCAGCTCTTGTCACCACGTCAACACCCTCTGCTTTGCCACA
GGGAAAAGGCATTGCTTTTACCAGGTCAGATGCGCCCACCTTTGGCCACAAAAACACTTGAGGAGCGGATATCGAAGCTTATCTCA
GACAATGAAGCTTGGTAGATGACAAGCAACTGGATAGTGTGAAGCCGCGGAGAACCTCACTGTCAAGCAGGAAGCATTGATTC
CCCCAAATCATACATATTTAAAGATTCTTTCCAGTTTGATTTAAAACCAGTGGGACGGAGAACAAGTTCAAGCTCTGATATACCGA
AGTCACCTTTCACCCCTACTGAAAAATCAAAGCAAGTGTTTCTTCTGACCTTCACTTGACTGTTTTACCTATCACAAGAAGT
AATTCCATGCCGACCACAGGTTATTCAGCAGTACCTGCAAATATAATACCTCCTCCTCATCCACTAAGAGGAAGTCAGTCATTTGA
TGACAAATTGGCGCTTTCTATGATGATGTCTTTGTATCGGGACCTAACGCTCCTGTGCCCCAGAGTGGGCATCCCCGTACACTTG
TGAGACAAGCAGCCATAGAAGACTCTTCAGCAAATGAAAGTCATGTTCTTGGTACTGGACAGTCCCTGGATGAGAGCCACCAAGGA
TGCCATGCTGCTGGTGAAGCCATGTCAGTGAGGAGCAAGGCACTTGCACCAAGGCCCACATATAGAAAAAAGAAGTCTCATCAAGG
GCGAGGGACAATGTTTGAGTGTGAAACTTGTAGAAACAGGTATAGGAAACTGGAAAATTTTGAAAATCATAAGAAATTTTACTGTT
CTGAGTTACATGGACCAAAAACAAAGGTAGCCATGAGAGAACCTGAGCACAGCCCTGTGCCCGGCGGTCTGCAACCTCAGATTCTA
CACTACAGAGTCGCTGGGTCCTCCGGCATCTGGGAACAGACGCCCCAGATAAGAAAAGGAGGAAATGAAAAGTGTTGGGGATGA
TGAAGAACTTCAGCAAATGAAAGTGGAACATCTCCAAAAAGTTCTGAAGGCCTTCAGTTTCAGATGCTCTGGGCTGTAATCCCA
GTTTGCCTAAACATAGTGTTACCATAAGAAGTGACCAGCAGCATAAAATATACAGTTGCAAAACTCCCATATTCACCTTGTTGCC
AGGGGCCCTGAGCAGACCATGGATCCCAAGCTGTCGACCATCATGGAACAACAGATAAGTTCAGCAGCCCAGGACAAGATAGAACT
GCAGAGACACGGAACTGGAATCTCTGTCATCCAGCACACCAACTCCCTGAGCAGGCCCAACTCATTTGACAAGCCTGAGCCTTTTG
AAAGAGCCTCCCCAGTTTCTTTCCAGGAGCTGAATAGAACGGGGAATTCCGGGTCTCTAAAAGTGATAGGAATCTCCCAAGAGGAA
AGTCACCCTTCTCGGGACGGGTCTCATCCTCACCAGCTTGCACTATCAGACGCTCTCAGAGGAGAACTTCAGGAAAGCTCCAGAAA

TABLE 1-continued

Sequences Table. First column: SEQ ID No. Second column: corresponding mRNA sequence. For the 3 different groups, see explanation in the text.

```
   GAGTCCAAGTGAACGACATGTGTTAGGACAGCCCTCAAGACTTATCCGGCAGCACAACATCCAAGTTCCAGAGATTTTGGTCACAG
   AAGAACCAGATCGAGACCTGGAAGCTCAATGCCATGATCAAGAAAAGTCAGAGAAGTTCAGTTGGCCCCAGCGTAGTGAAACCTTG
   TCAAAATTGCCAACAGAGAAACTGCCACCCAAAAAGAAAAGGCTCCGTCTGGCTGAGATAGAACATTCCTCAACAGAATCGAGCTT
   TGATTCCACTCTCTCCAGGAGTCTAAGTAGGGAGCAGTTTATCTCACACTTCAAGTTTCTCAGCCTCTTTTAGACATAGAGGACG
   TTTCTAAAACGGAGGCTTCCCCCAAAATCGATTTTCTAAATAAAGCCGAGTTTCTTTATGATTCCAGCTGGCTTGAATACTCTGAAT
   GTTCCTGGATGTCACCGGGAAATGAGGCGTACTGCATCAGAACAGATTAATTGCACGCAAACGTCAATGGAGGTCTCTGATCTCAG
   AAGCAAATCATTCGATTGTGGAAGCATCACCCCACCCCAGACAACACCCACTTACTGAATTGCAGCCTCCATCTTCACCTTCTCGAG
   TGGGAGTGACTGGGCATGTGCCTCTCTTAGAAAGAAGGAGGAGGCCCACTGGTACGGCAAATATCTTTGGGCATAGCCCCAGATAGT
   CATCTGTCTCCTGTACACCCAACATCTTTCCAAAATACTGCTCTTCCCAGTGTGAATGCAGTGCATATCAGGGGCCTCAGCTCAC
   TAGTACATCTTTAGCTGAGTTTTCTGCAAATACTTTGCACTCTCAGACTCAGGTTAAGGATCTGCAGGCAGAAACATCAAACTCCA
   GCTCTACCAACGTTTTTCCTGTTCAACAGCTCTGTGATATCAATTTGTTAAATCAAATCCATGCACCGCCTAGCCACCAGAGCACA
   CAGCTATCTCTGCAAGTGTCTACGCAGGGTAGCAAGCCAGATAAAAATTCTGTTTTATCTGGGTCTTCTAAAAGTGAGGATTGCTT
   TGCTCCCAAATACCAATTGCATTGTCAGGTTTTCACTTCAGGCCCATCTTGCTCTTCTAATCCTGTGCATTCTTTTGCCAAATCAAG
   TTATTTCAGATCCAGTTGGAACAGATCATTGTGTGACATCAGCAACATTACCAACCAAATTAATTGACAGCATGTCTAATTCGCAT
   CCTCTGCTACCACCAGAGCTCAGGCCCCTTGGAAGTCAGGTGCAGAAGGTGCCATCATCATTCATGCTGCCCATACGCCTGCAGAG
   TAGTGTTCCTGCTTACTGTTTGCTACACTCACATCCCTGCCACAAATACTAGTGACCCAAGATCTGCCCAATCAGCCAATTTGCC
   AGACTAATCATAGTGTAGTGCCAATCAGTGAAGAACAAAATTCTGTGCCAACATTACAAAAAGGTCATCAGAATGCTTTGCCAAAC
   CCAGAGAAGGAATTTCTATGTGAAAATGTTTTTTCAGAGATGAGCCAAAATTCTTCTCTATCAGAATCCTTGCCCATAACTCAGAA
   AATATCTGTTGGTCGACTTTCCCCTCAACAAGAATCTTCAGCTTCGAGTAAAAGGATGCTTTCCCCAGCAAATAGTTTAGACATTG
   CCATGGAAAAGCACCAGAAGCGGGCCAAAGATGAAAATGGAGCTGTTTGTGCAACAGACGTGAGACCTTTAGAGGCTTTGAGTTCG
   AGAGTTAATGAAGCTAGTAAACAGAAGAAGCCTATTTTAGTGAGACAGGTTTGTACTACAGAGCCCCTGGACGGTGTGATGTTGGA
   AAAGGATGTTTTTTCTCAACCTGAAATTAGTAATGAGGCTGTTAATTTGACAAATGTTTTACCAGCTGATAATTCATCAACAGGAT
   GCTCTAAATTTGTCGTTATAGAACCTATAAGTGAATTGCAGGAATTTGAAAACATCAAGTCATCCACATCATTAACTCTTACAGTT
   CGAAGTTCACCTGCTCCTTCAGAAAATACTCATCTTTCTCCTTTGAAATGTACAGACAATAACCAAGAAAGGAAGTCTCCAGGGGT
   TAAAAATCAAGGTGACAAAGTGAACATCCAAGAGCAAAGTCAACGGCCAGTCACTTCTCTTTCATTGTTTAACATCAAGGACACCC
   AGCAGCTGGCTTTCCCTAGCCTGAAAACTACAACCAACTTTACATGGTGTTATCTCTTAAGGCAGAAGTCGTTGCATTTGCCTCAG
   AAGGACCAGAAAACTTCAGCCTATACTGATTGGACAGTAAGCGCCAGTAATCCAAATCCACTCGGTTTGCCCACAAAAGTTGCACT
   TGCTCTCCTTAATTCAAAACAGAACACTGGAAAATCACTATACTGTCAAGCAATAACTACCCATTCCAAGTCAGACTTATTGGTCT
   ATTCAAGCAAGTGGAAAAGCAGCTTAAGCAAGAGGACATTAGGTAATCAAAAGTCCACAGTAGTTGAATTCAGCAATAAAGATGCC
   TCTGAAATTAACAGTGAGCAAGATAAAGAAAATTCCTTAATCAAAAGTGAACCAAGAAGAATTAAAATATTTGATGGAGGATATAA
   GTCAAATGAAGAGTATGTATATATCCGAGGCAGGGGAAGAGGAAATACATTTGTGAAGAATGTGGAATACGTTGTAAGAAACCTA
   GCATGTTAAAGAAACACATACGAACCCATACAGATGTCCGCCCCTACCACTGCACTTACTGTAACTTCTCCTTTAAGACTAAAGGA
   AATCTGACAAAACACATGAAGTCCAAGGCACATAGCAAGAAATGTGTGGGATTTAGGCATCTCAGTAGGTTTAATAGATGAACAGGA
   TACAGAAGAATCAGATGAAAAACAGAGATTCAGTTATGAGCGATCTGGATATGATCTTGAAGAATCTGATGGCCCAGATGAGGATG
   ACAATGAAAATGAAGACGATGATGAGGACAGCCAGGCTGAATCAGTCCTGTCAGCCACACCCTCAGTCACAGCTAGCCCGCAGCAC
   CTTCCATCTAGAAGTAGCCTTCAGGACCCTGTGAGTACTGACGAGGATGTCAGGATCACCGATTGCTTTTCTGGGGTACACACGGA
   CCCAATGGACGTTCTGCCCAGGGCGCTGCTCACCAGAATGACTGTCCTGAGCACAGCACAGTCTGACTACAATAGGAAGACACTCT
   CTCCGGGAAGGCCCAGGCAGCGTGCTGCGAGAGATGAAAACGACACAATTCCGTCTGTAGACACTTCCAGGTCCCCGTGTCATCAG
   ATGTCTGTGGACTACCCTGAGTCAGAAGAAATTCTGAGAAGTTCTATGGCAGGAAAAGCTGTTGCTATAACACAGAGCCCATCATC
   TGTAAGACTTCCTCCTGCTGCAGCTGAGCACAGCCCCAGACAGCAGCGGGGATGCCTTCTGTGGCCTCACCACATCCTGACCCTC
   AAGAACAGAAGCAGCAAATAACTCTACAGCCGACTCCAGGCTTGCCTTCTCCCCACACTCATTTGTTTAGCCACCTTCCTTTGCAT
   TCCCAGCAGCAATCGAGGACACCTTTATAATATGGTTCCAGTTGGGAGCCGCTGTAAACGTCGTGAGGGTGCTGCCTCACATACTCCACGTT
   TGTGCCCCTTCAGGCTGGACCAGTGCAGCTCACGATCCCTGCTGTCAGTGTCGTTCACAGAACTTTGGGTACTCATAGGAATACGG
   TCACAGAAGTGTCTGGCACTACAAACCCTGCTGGAGTGGCTGAATTAAGCAGTGTTGTGCCATGTATTCCTATCGGCCAAATCCGC
   GTGCCAGGCCTTCAGAACCTAAGTACCCCAGGCTTGCAGTCACTCCCCTCGTTAAGCATGGAAACCGTCAATATTGTAGGCCTAGC
   CAATACAAATATGGCCCCACAAGTCCATCCACCAGGACTGGCTCTGAATGCTGTCGGACTGCAGGTTCTGACTGCAAACCCTTCAT
   CACAAAGCAGCCCGCCCCTCAGGCACACATTCCAGGTCTCCAGATCTTGAACATAGCATTGCCCACCTTAATCCCCTCAGTCAGT
   CAAGTAGCCGTTGATGCACAGGGAGCTCCAGAAATGCCAGCTTCCAAAGCAAAGCATGCGAGACACAACCCAAGCAGACTTCTGT
   AGCCAGCGCAAACCAGGTCAGCAGGACCGAGTCTCCTCAGGGGTTACCTACAGTCCAGCGGGAAATGCAAAAAAGTTCTGAATC
   CACCTGCCCCTGCAGGTGACCATGCAAGGCTTGATGGCCTGGTAAAATGGACACAGAGAAGGCTGCCTCGGCAAATCACGTGAAG
   CCCAAGCCTGAACTCACTTCCATACAGGGCCAACCAGCGTCCACGTCACAACCTCTGCTGAAGGCACATTCTGAAGTTTTTACAAA
   GCCCTCAGGCCAGCAGACTCTCTCTCCAGACAGACAGGTTCCCAGGCCCACAGGACTACCGCGGAGGCAGCCCACTGTGCACTTCA
   GCGACGTGAGCAGCGATGATGACGAGGACAGGCTTGTGATAGCAACCTGATGGATTTTATTTTTATTTGCTTTTTTTTTATATAA
   CACTTAAAGGTTTCTTTGAAAACCCTCCTTTCCTTAAAGCACATTTTTCTGACATAAACTCATGACTAATCTTTGTGCAATCATGA
   ACTTTTGACCAATAATTGTTGTTTTTGTGTCAGCTCCAGCCATTTTTGTACATGTTGTATAGACAATTGTGCCTTTTAGGAGCTTTA
   TGTTTAGAAACTGTACAGATTGTTGAATATCTATATACATAAAAATATATTATATATGTATATGAAAACCAGGTAGTTATTTGTGT
   TTAGTAAGGAAAACCTGTCAAATAAATCAAATGATTAAATTATATGTTCCACTGTTGAATATAAATTTTATGGCTATGGGCAGAG
   TTTCTGTGTATAAATTAGTATGTAAACTCCATATTTATGTATTCATATTAGTCTTTGAAATGGGTCTGTCCTCCTTGTGTAAGAC
   AGTAACTTTACACTTCAGACAGATTTTCTGTGTTATGAAATGTTTCAGTAAAATATTGTTTACTGACCTTTAAAAA
56 GAGGCCGGGCAGGGGCGGGGCCGGCGAATGCCCGTCCCGACCCGTCGCGCCTCCCCTGTTAGCTCCCTGCCAGCCGAGGCGGGC
   GAACCTCTGCCCTGTTGCGTGGGAGTGACTCACAGCTCCCGCCCCTTTTGGCTCCGCTTTCTCGCGGCCAGTCCCTCGCACCACGT
   GCCCTCCTGGCCGCGCCCCCAGCTGCCCTTTCCAACTGCCTGTGTAAAACGTCGTGAGGAGCGCGCTGCTTAC
   GGCTGCCTCTCCCAGACTAGAGCCCGGAGCGCCCACCGCCGTCAGCGCGTCTTCAAGCTAGTCGGCCCCGCGGAGAGCGAGAGA
   CCCTGCGCACCGCAGCCCTCTCCGCTGCGCCCATTCCTGCCGCCGGCGATGTAACTCGGGGAGGCAGCGGTGCCCGCTGGCCCGGG
   GTTGAGACAGGCGGCAGGTGCCTGTGAGGCGGGCGGGTGCCGGGGGCCAGCAGGATGGAGGAAAGCATGGAAGAGGAGGAGGGGGG
   CAGCTACGAGGCGATGATGGACGACCAGAACACAACTGGGAGGCTGCGGTGGACGGCTTCCGGCAGCCCCTGCCACCTCCGC
   CGCCCCCCTCGTCGATCCCGGCCCCTGCCCGAGACCTCCGGGGGGCAGCTGCTGGCGGTGCCCGCGGTCTCCGTGGACAGGAAA
   GGCCCCAAGGAGGGGCTCCCGATGGGGCGCAGCCACCGCCGGAGGCTAATGGGGTGATCATGATGTTGAAGAGCTGCGACGCGGC
   CGCCGCCGTGCCAAGGCGGCCCCCGCCCCACCGCCAGCTCCACCATCAACATCAACACCTCCACCTCCAAGTTCTTAATGAATG
   TTATAACTATTGAAGATTATAAGACACTACTGGCCAAATTGGGTGGTGCCATAGATCTACTTTTAACTCAGAGTCTGGTGAC
   TATATCCCCATATCCTATGAACAGATATACAGTTGTGTGTATAAATGTGTATGCCAGCAGCACTCGGAACAGATGTATAGTGATCT
   GATTAAAAAGATAACTAATCACTTAGAGAGAGTCTCAAAGGAGCTGCAGGCCAGCCCTCCAGATCTCTATATTGAAAGATTTAATA
   TAGCTCTTGGACAATATATGGGAGCATTGCAGAGCATTGTGCCTCTTTTCATATATATGAATAAGTTTTACATCGAAACCAAGCTT
   AACAGAGACTTAAAAGATGACCTTATAAAGCTGTTTACGGAACATGTTGCAGAAAAGCACATTTACAGCCTAATGCCTTTACTTTT
   AGAAGCCCAGTCAACACCATTTCAGGTCACACCTTCAACTATGGCAAATATTGTGAAAGGCCTGTATACCCTCAGACCAGTAGTGG
```

TABLE 1-continued

Sequences Table. First column: SEQ ID No. Second column: corresponding mRNA sequence. For the 3 different groups, see explanation in the text.

|   |   |
|---|---|
|   | GTTCAGATGGCTCCAACTCTATTTTCTAAATTTATTCCAAACATTCTCCCTCCGGCGGTGGAATCTGAACTTTCTGAATATGCTGC<br>TCAAGATCAGAAATTTCAAAGAGAACTTATACAGAATGGTTTTACAAGGGGTGACCAGTCCCGGAAGAGAGCTGGGGATGAGTTGG<br>CTTATAATAGCTCGTCAGCATGTGCAAGTTCCAGGGGGTACAGATAGTGAATGTATTGAATATGCTTTCCTTCCTGAAAAGAGGAC<br>ACACTGGAGCTGCAGAGACTGTATTCAGAGCACAGTGGGGGCTGCACACACTCAGGACTCTGTCACAAAGCTGTTCATGGAAGAG<br>GATGTTGGACTTCTTACTTGGTTTGTAATTTTAAAACAAAAACTAAAAAAAAAAAAAAACGTTGCTGCTAGACTTGGGGGTGATTTT<br>GAAATGGGACAATCTTTTAATGAGTTTATCTACAGATTCTGTGAGGAAAAAGCATCTCAGAAAGTGACCATTTCTAAGTGAAATCT<br>GACAGCCAAAATCAGCAGCTTCCTCCAAAAATATAAGAGCAGAAGAATTTTTTTTTAAGCACTTGTTTTGTTCATTTGTGGACTT<br>GGCATTTTGGTGTATTGGTTTCACATGTCAGGATCTCTTTTGCTTTAAAACCAAGCAGATCATTACAGTACAGTATTTTTCACCCA<br>CAACCAAAACAACCCCTTTTAAAAGAGTTGGTCTTTGTTTAGCATTAGAAAGTCTTGTTAAAGGAAAATGCTAACTCTGCTTTTGC<br>TAGAACTTTCCCCCATCAGTTCACAACTTTCTTCTACTCTGTGCCTTGAGCTTTGTGCACTTTGCAACTGTGTGACCATGTTGTCA<br>AACTCCTCCTGGAGAAGTGTATGGTATCTAAACTCACCCACCAAGATGGCAGGTGTGGCCCTGTAGCAGGATGCTAATTAAGTGGG<br>AAAATAGAAACCTTTTGCACATGGGTCGGATTTTCCCCTGGTTCACCAGAGCATATTCATATTAATGTTGGGGACCAACTCTCCTA<br>GAGCATTTCCATTCCCTGTGCCACTTAACACGATGTCTGTCACCAGCTGCTATAGTATTGGCAGTACTCTAGTTTAGGGATGGGCG<br>GTACTTTAGCACGGAAGCTTCCCTTAGTATTATTGAGAGCTACTTCCTGCGATGCTCTAGGAAGCAGATACAGTTATTAAGTCCAA<br>ATACACAGTGGTGTGGGGTTCCTGATCACTTCATTTTAAATGAATGAGATAATTACTTAAAAAAAGTCTGTCATTTGAACATTATA<br>TTTGAGTGTGATAGGGAAGAAGTAGCACTGCTGTCCTAAGGCTCCCTTCCAGCTGTGGCAAAGCTATATTTCTGTTTCTCCACATC<br>CACAGTGCTTTTAGTCCATCATAAAAGTTTCTGAAGCTTATTCTGGCTGTTGTTGAAAGCCCAAGAAAAATAGATGTGGCAAGAG<br>AAAAATACTTTTCTTCTCAATTTTGCTTGAATCTTAATTGAGCATAGGCTTCTCTACTAGGCAACATCAGACTAATAGTATTTACC<br>TCTTCAGAGAACTTGAGGGGAAAAGAAACATCCCAGGGATGCTGTCGCATGTCTGCTCTGCAGGTTCTTCATACAGCTGCCTCTGC<br>CAATTCAGTTTATTTTTTGGGGGGAGTGGTGTGGGTGGGAGAGTTAGAAGTGGGATATTGGGAGCAAGTAAGTCACCCAATAATTG<br>AAGTCCTTGATTTGTAAAACTGTTATACAGAGAAGTAAAGATAAAGGTTGCTATATAAAGTTTATTTTTTAAAGTACTTAACCAGAGTTG<br>TGGATTTTGTGGACTTTAATTGGACTCAATTCACTCTGTGAGCATCCTGGATTGCATCGATGAACACTGAATTACTGTAAGAACAT<br>AGACAGGCTCTCACTATGACCTGGACAGTTTAAGTTGCTACACTGGTAACATTCTAGTATCAAGGAGAATTCCATTCATCATGACA<br>TTCACATTTTACTTTTCTCAATGGAATGCTTGCTTCAGGCTTACCAATCACACCTAGAACTGAAGTCTGAGTGAGTGGTATTAATA<br>ATTTTTCTGAAAGGAATAAAATTGGAATGTTTCTAAATGTGGAGAATTCTTCAGTATCCTAATAATATACCCAAATGCTTTTTCT<br>GGGAGAGAGCATTCTTTTACAAAAGAACTTTCCCTATAAAAGCATCACAGTATAATGTGAATTGGCATTAAAATCTTTGGATGCTT<br>TTGCATTATTAAAGTTCATGGAGAAATATATTCTTTTTACTATGTATGTATTAATAAAAAGTGGGCAAAGTAAAGTTTGCAAAATT<br>TAGTTTCTCTAAATTTTTGCACAGTGACTGCAGCTGGCTATGGGTCAGCTCTTAATACAACAAAACCTTGACTGGAAGTCACTATA<br>GAAAGGTTGTACATAGTCTCCCAGTCTACATGTCCTGGCTGTTAACATCTTGGCCCCTTGAGGCACATCACAGTTTGAAGGACCT<br>GTTTAAGTTGAAATAGACTTTGCTTATTTATTGGGATTCTAAAAAATTCTGAGTGAGTTTGCAGTATGAGAGGAAATAAGATTTCC<br>TCCTCCTTCCTCTCATTTTATATTGACTGTTTGCCAGAAACTGTTTTCTTCTGTTTTCTTATATTTTGTTTTTGAGATGGAGTCTC<br>ACTCTCTCACCCAGGCTGGAGTGCAGTGGTGCAATCTCAGCTCACTGCAACCTCTGCCTCCTGGGTTCAAGTGATTCTCCTGCCTC<br>GGCCTCCTGAGTAGCTGGAATTACAGGCACGTGCCACTACGCCCGGCTACTTTTTGTATTTTGTTTTTAGTAGAGACGGGGTTTCA<br>CCATGTTGGTCAGGCTGGTCTTGAACTCCTGACCTCAAGTGATCCACCCACCTCGGCCTCCCAAAGTGCTGGGATTATAGGTGTGA<br>GCCACTGCACCTGGCCAAAAAAAAAAAAAAAAAAAA |
| 57 | AAAACTCAGCTATGCAAAGCAACTCAGGAATCTTTCAAAGAAGTACCAACCTAAAAGAACTCGAAGGAGGAAGAAGAATACAAGT<br>ATACGTCATGTAAAGCTTTCATTTCCAACCTGAACGAAATGAATTGATTACGCAGGGCAGCATGAAGTTTATCTCCGAGAACATGGCA<br>TCACAGATCATTGTGGACTTGGCACGCTATGTTCAGGAACTGAAACAGGAGAGGAAATCAAACTTTCACGATGGCCGTAAAGCACA<br>GCAGCACATCGAGACTTGCTGGAAGCAGCTTGAATCTAGTAAAAGGCGATTTGAACGCGATTGCAAAGAGGCGGACAGGGCGCAGC<br>AGTACTTTGAGAAAATGGACGCTGACATCAATGTCACAAAAGCGGATGTTGAAAAGGCCCGACAACAAGCTCAAATACGTCACCAA<br>ATGGCAGAGGACACGCAAAGCAGATTACTCATCCATTCTCCAGAAATTCAACCATGACGCAGCATGAATATTACCATACTCACATCCC<br>CAACATCTTCCAGAAAATACAAGAGATGGAGGAAAGGAGGATTGTGAGAATGGGAGAGTCCATGACACATATGCAGAGGTTGATC<br>GGCAGGTGATCCCAATCATTGGGAAGTGCCTGGATGGAATAGTAAAAGCAGCCGATCAATTGATCAGAAAAATGATTCACAGCTG<br>GTAATAGAAGCTTATAAATCAGGGTTTGAGCCTCCTGGAGACATTGAATTTGAGGATTACACTCAGCCAATGAAGCGCACTGTGTC<br>AGATAACAGCCTTTCAAATTCCAGAGGAGAAGGCAAACCAGACCTCAAATTTGGTGGCAAATCCAAAGGAAAGTTATGGCCGTTCA<br>TCAAAAAAAATAAGCCTCCCCCTCCCCCTCCTGCCTCTGCCTCACCCTCTGCTGTTCCCAACGGCCCCCAGTCTCCCAAGCAGCA<br>AAAGGAACCCCTCTCCCACCGCTTCAACGAGTTCATGACCTCCAAACCCAAAATCCACTGCTTCAGGAGCCTAAAGCGTGGGGGTG<br>CAACACCGGAGGATTTCAGCAACCTCCCACCTGAACAAAGAAGGAAAAAGCTGCAGCAGAAAGTCGATGGGTTAAATAAAGAAATT<br>CAGAAGGAGATGGATCAAAGAGATGCCATAACAAAAATGAAAGGTTGTACCTAAAGAATCTCAGATGGGAGACCCAGCCAGTTT<br>GGATCACAAATTAGCAGAAGTCAGCCAAAATATAGAGAAACTGCGAGTAGAACCCAGAAATTTGAGGCCTGGCTGGCTGAGGTTG<br>AAGGCCGGCTCCAGCACGCAGCGAGCAGGCGCGCCGGCAGAGCGGACTGTACGACAGCCAGAACCCACCCACAGTCAACAACTGC<br>GCCCAGGACCGTGAGAGCCCAGATGGCAGTTACACAGAGGAGCAGAGTCAGGAGAGTGAGATGAAGGTGCTGGCCACGGATTTTGA<br>CGACGAGTTTGATGATGAGGAGCCCCTCCCTGCCATAGGGACGTGCAAAGCTCTCTACACATTTGAAGGTCAGATGAGGGAACGA<br>TTTCCGTAGTTGAAGGAGAAACATTGTATGTCATAGAGGAAGACAAAGGCGATGGCTGGACCCGCATTCGGAGAAATGAAGATGAA<br>GAGGGTTATGTCCCCACTTCATATGTCGAAGTCTGTTTGGACAAAAATGCCAAAGGTGCTAAGACTTATATTTAATACCATAAAAA<br>AAAAAAAACTTAAAAAAAATGGAGTTGTTTCTCCCACAACCGTGACTGTTACAGGCAGTTCCTCAAGAGACTGGCTGGCAAGCAC<br>CATAATGCACGTTCTCCTGTAGTCTCACGTGGACTTCAGGGTCCGGGCACCTGAATTGCCTTGTCTAGTTTGGGCTGTAATCAAGT<br>TTCACTTGCTGATGAAATTTTATGTGGAAAGCTGCCAACCGCCAACTTACAGCTATGTCATTCAAAATCTGATAAACATTTCTTCT<br>TTTGGCGGTATCTGTAGATTAAAAAAAAAAGTTGCATTGTAGCTTCTCATCTTTCTGAATTTAAAAGCCGGCACGCATCATGCAGGT<br>GCCAAAGACTTCCCTACTCTTGTTTATATCTAGTATCCACCATACACTGAGCTACATTAGGTGGTTACAGATTGTAACTTAATAAA<br>CTGAACTGTGTTAGTTTGTTAAATTGTATACTCATTCACTTGGGAGGAAGTCACAAGTGAAATAACATCTCCTTCTTGACTAAAGC<br>AGTAAATAAGATTCTTATATTGGC |
| 58 | GGGGGCCGCTACGGTGCTGACAAGATGGCGGCTGGCGGAGCTGTCGCTGCGGCGCCCGAGTGCCGGCTTCTCCCCTACGCGCTACA<br>CAAGTGGAGCTCCTTTTCCTCCACCTACCTTCCCGAGAACATTTTAGTGGACAAACCAAATGACCAATCTTCAAGATGGTCTTCAG<br>AGAGCAACTATCCTCCCAGTACTTGATTCTAAAGCTCGAAAGGCCTGCTATAGTTCAGAATATCACATTTGGAAAATATGAGAAA<br>ACTCATGTTTGCAATTTGAAGAAATTTAAAGTCTTTGGTGGAATGAATGAAGAAATATGACAGAGCTGTTGTCCAGTGGCTTAAA<br>GAATGATTATAACAAAGAAACATTCACCTTGAAGCATAAAATTGATGAACAGATGTTCCCTTGTCGATTCATTAAAATAGTTCCAC<br>TCTTGTCCTGGGGACCCAGCTTTAACTTTAGCATCTGGTATGTTGAACTTAGTGGCATTGATGATCCTGATATAGTACAACCTTGT<br>CTCAACTGGTATAGCAAGTACCGTGAACAGGAAGCTATTCGCCTTTGCCTAAACACTTCAGACAACACACATACAGAAGCTTT<br>TGAGTCACTGCAAAAGAAAACCAAGATTGCACTGGAACATCCCATGTTAACAGATATTCATGACAAGCTGGTGTTGAAGGGTGATT<br>TTGATGCTTGCGAAGAGTTGATTGAAAAGGCTGTAAATGATGGCTTGTTCAATCAGTATATCAGTCAACAGGAATATAAGCCACGA<br>TGGAGTCAAATCATTCCCAAAAGTACCAAAGGTGATGGGGAAGATAACCGTCCAGGAATGAGAGGAGGCCATCAGATGGTTATTGA<br>TGTTCAAACAGAGACTGTTTATTTGTTTGGTGGCTGGGATGGAACACAAGATCTTGCTGACTTCTGGGCGTACAGTGTGAAGGAGA<br>ACCAGTGGACATGTATCTCTAGAGACACTGAAAAAGAGAATGGTCCTAGTGCCAGATCGTGTCATAAAATGTGCATTGATATTCAA |

TABLE 1-continued

Sequences Table. First column: SEQ ID No. Second column: corresponding mRNA sequence. For the 3 different groups, see explanation in the text.

```
CGGAGGCAAATCTACACATTGGGGCGTTACTTGGATTCCTCTGTGAGGAACAGCAAATCTCTGAAAAGTGACTTCTATCGTTATGA
CATTGATACAAACACATGGATGTTACTAAGTGAGGATACTGCTGCTGATGGAGGGCCGAAATTGGTGTTTGATCATCAGATGTGTA
TGGACTCAGAAAAACATATGATCTACACTTTTGGTGGTAGAATTTTGACTTGTAATGGCAGCGTAGATGACAGCAGAGCCAGTGAA
CCACAATTCAGTGGCTTGTTTGCTTTCAACTGTCAATGTCAAACCTGGAAACTTCTTCGAGAGGACTCCTGTAATGCTGGGCCTGA
GGACATCCAGTCTCGAATAGGACACTGCATGTTATTCCACTCAAAAAATCGTTGCTTATATGTATTTGGTGGCCAGCGATCAAAGA
CCTATTTGAATGATTTCTTTAGTTATGATGTGGACTCTGATCATGTAGACATAATATCAGATGGCACCAAGAAAGACTCTGGGATG
GTTCCAATGACAGGATTTACACAGAGAGCAACTATTGATCCAGAACTGAATGAAATACACGTCTTATCTGGACTCAGCAAAGATAA
GGAAAAGAGGGAAGAAAATGTTAGAAATTCATTCTGGATTTATGACATTGTGAGGAATAGTTGGTCTTGTGTCTATAAGAATGATC
AAGCTGCAAAGGATAATCCAACTAAAAGTCTTCAGGAAGAAGAACCATGTCCAAGGTTTGCCCATCAGCTTGTATACGATGAGCTA
CACAAGGTTCATTACTTATTTGGTGGGAATCCAGGAAAATCTTGCTCTCCAAAGATGAGATTAGATGACTTCTGGTCACTGAAGTT
GTGTAGACCTTCAAAAGATTATTTACTGAGGCATTGCAAGTACCTCATAAGAAAACACAGGTTTGAAGAAAAGGCCCAAGTGGATC
CCCTTAGTGCTCTGAAATATTTACAAAATGATCTTTATATAACTGTGGATCATTCAGACCCAGAAGAGACAAAAGAGTTTCAGCTC
CTGGCATCAGCTCTATTCAAATCTGGTTCAGATTTTTACAGCTCTGGGCTTTTCTGATGTGGATCACACCTATGCTCAAAGAACTCA
GCTCTTTGACACCTTAGTAAATTTCTTTCCTGACAGCATGACTCCTCCTAAAGGCAACCTGGTAGACCTCATCACACTGTAACTGA
AGAGTCACTGGACACAGAAATGGAAAACAGGAGTCGATTTTCCGTCTTTTGGATTGCAGCTCCACTGACTGACAGTAAAGCTGCAG
TGATTGAGGACTGCACCAGAGTTCTGAAGGGATCTTAACCATCACAAGTTTTTACCCTCTTCCTTCATGCCTGACCTCAACCCCGC
TCTCCTCATCCTATTCCTAAATTAGGCTAATAAAGTGAAATTGGTATACTTTCCAGTTAAATATATATATATATATATTTTTCTT
ACTTTATCTTTTAAGAATTAATGAGTATAAAAGAAAAATTAGGCAGTTTACCCTTTTCAGATTTTTATTTCTTTTTTTTTTAATTG
GGGGAAATAAGCACTATTAACAGATTCAGCACTACAAGTATTTTGAATGTTGTTGCTGTTGGTCATTTGGCCTGCCTTTTCCCTTC
CTATTTCACTTTGCCTCCCATCACACAACTGCGTGTAAATGGTGTCACTTGTTCACCTCTTTACTTCATTCTTAACAAGTGTATAG
TTCTCTAGGACAGTTGATGTATGTTAAGGTGATATCTGTGTCTGTATTGACTTGTCTTGTGTTACATTAAACAGTAGGCAGAACTG
AGGTCTCAAGTTTGCACTCTTGGCCATAGAACTAAAAATGAAACCTGAGATTGACCCAAGCACCTATCTGAGATTGGTATATAATA
TTTCTATAATGATATATTTTATAGTAGATATTACAATAGCATCTGACTTTGAGTCACAGAAACCTTAAACTGAGGAGACAATAGTT
CAGAACCTTTTTAAGAGCCATTCTAAAAGTGACCAGCAGGAGGGATCTAGTAGTGAATAATATCTTAATAGCAATTTTAGGAGAAA
ATGACTCTTTCGTCCAGAAGAGCTCTGCAGAACCAGGGCTCCCGTTTATCTTGTGCTATCTCTGTAGTATTTTCATTTGAGAGAGG
AGGCTGAGTTTCCAGAGCTTTGCTTTCATTTATTTTTATACACATTGTCTCTCTATATCTGCTTGTGGATATTGTTATTTTGAAGA
GAAATGGTTTGTGGTTGTCCAGTGGTATACAACTGACAGGCATTTCATTAAGCACATAGACCAGACTTTGTGAATGGTTCAGATAT
TTTTTCATTAAAAAACAAGGTATGGCAGATGGACTTTTCCATGGGTCAAATTTTTGTGTGAGAGATAGAGGTACATGTCTTCTGA
TGATGTGCTGTGGAATGCAATGTGGGAAACCTACATCTGGCTAGTGCTTACATTTGCTCAAAAAGCATGTTGTATGAAGCTGACTG
CCACCATGCTAAAGCAGATTCATATTAAGAAGTGTCGGTCGATCCAGTGGCTCTTAAGAGTGAATAGCTTTATGGAATCAAGTATG
TCCCTGAGTAGCAAGATTAGGCCTCACCAAAGAAGAAATTAACCTGCACTTTCAAAAAGTACCATGTATAGGAATGAAACATTGAG
GTCCCACTTTATTCTGTCTTTAGTACATGGTTTTACTTATTTTGGGGATGGATAGAAATATATTTTTGCTAGTTCTAGGCTTGAAT
CATGGGCTCCTTGGCTTTCCTAGCATCCCAAAGCAGTCAACAGTGATTTCTTAAGCAATTTGATCTGTACCTTTACTTGTGAAAGG
TATGCTATATAATTCAGCAAGTACCAACTTGTGTAGCTGCAGAATAACCAAGTGGCTATCCAGTCAAGTAAATACAGTTTGCTTAC
ATACTTCAACAGTTTCATAAAACGATTCCCCTGAGTGACACAAGAACATAAAATGTTAATATCACTAATATAGCCTGTTAAATCTT
TTGTGGAGACAGGTGCAAATCAGAAGATTGACAAGGAAGAACTTGAGCTTGCTAAATAAGACTTCCTAAATTTAAAAGCTCTAGTT
TTGCTTAGTGTGAATTCTGGCACTTTAAAAAGATTAAGCAAGTGAAATTCTGCTGCCCTCCACCATTTATTTTTACAGTGCTTTGT
AATTTTTTTCATCAGTTCCTTAAATGTTATTTGGAGGAAACTAAGTTCTTGACCTCAGTAATTTTATTTTTGTTTTTCCCTAAATG
TTTCCCTACTAGTCTTTTTGGAAAACATGTTTGTTTTAATTTCATCTTCCCTCACTTTATTTAGGTAGAATTTTTCCCCCTTCATT
TCTGAAATTTTTGCTCACCGCCATGTTTAAATGGGGTTGAATCATAGCGAGCCATTTGCTCTTGCCAAAGTGAGATAGATGTACT
GAGGAGATAATTGAAAAGTCAGACTCTGTACTGTGGGGCTTTAATCGGAGCACTGCTGGAAATGATTGCAGAGAATGTAGTGCTTC
ATATATCCATGACCAAGATTGACATGTTGCTCACAACATGTCACAATTTAGTGAGGAGCTACATGTATTTCCAAGAATTCCAGCAT
AGATTATAATTTAAATAATCGAATTTGGTATTTAGGTACATTGTTTATATAGCCAAGTGTATATGCTTTACTACCTAACAATTATT
CTAGCCTAGGTGAATCCCTAATTGAAACACCTGGCTAACACTTTAGACACATAAATTAAGTGGGATACAGTTTTCTCATTTGTATT
ATCTCCAGCTTCAACCTCATTTATCCTTTTTCCTAGTATAATACATTGTTTTCAACCAGAAATTAAAGTAGATATCCAACATTATT
TTCAGTGCTTGTACTTCATGAGAAATAATCTGATTTTCAAGACACCTCTTAAGTGCATTTGATCTCATTTTATTTTTGGTAATGGCAGAGA
CCTCATGTGGCCAGTTTGATTGATTGAAGAATGTATCACTCTTATTCAAGCAAAGGAATTCAGACTTAAATGCCTACCTCTGTGCT
GAAGCTGACAGACAGTATTAACTCTTATCAAGGCCATCTTTTAGACCTGATTTTCATTTATATGAAAACAGACCTGTCCATGTCTA
ATAAGTAAAACTGATAGAATACATTAAAAAGTCACTGGTTTATCATAGAAAAGTTTGATGGGTTTAGAGCTCAGTGATTTAAGCT
TGTAAAACTGCATTCTTGGGCAAAATATTTATATTGTATAATGACTTGGCTTATTCCAGTTGATCTCTTCACATCTGCCTT
AAAAGTGCTATGTAGAGATACATTAACAGAGTTATAATAAAACAGTGTTTTAAAATCTAGCCTATAAACAAAAACTAGTTTGAGGC
ACCCAAGCATTTAGTGAGAGATTGAGAATGATGCTTAATGGATCAAAAAAGCAATTAGGAGTATGTTCCTGATTTTATTCTCTAAA
TTATACTCAATTTCATGGTAATTACATGAAGAAGTTACCTGCAATTATTCTTAACACTACATGGAATTCACTGGGTAATTGTGGGT
CATTTATTTCCTGAAAGTCACGTGAAATCCTTAGCTGGTTGAATGTTGCACAGTATTTGAGAATTACGGTTTGAAGTGATTTCTGT
GGGAGGGAATCATTGCAATGTATATTCTAAATAAAGTCATCTAACTATTAAAAAAAAAACACCCTTCCTAACCCTTCTTTTCTTAA
AATTCCACATTCATCCCACAATCTCATCCCTTTGTAGAAATTCTTGCCTGAATTCTCACCAAGTTTTGAATTCCTAAGGTAGCCCCG
ATCTAGGATGTGAAGGCTGCCCAGAAAAAGTTTATGGCTGGAGGAGTATCATACAGTGTCTACATATGATAGTACTTACAGATTAG
GTCTTTGGATGCTTAACACAAAAGATTTTTGTTATCCTTATTAGTCAAATAACGCTATTCTTTTGTGGTTCTAGACCCTGGCTTC
TATCTCCCTGTGATTTGTTTTAATGCTGAAATGACTTGGCTATCCAAAGCTTCTAGTCTAGAGGTCTGTTGGTTGAAGGCAGACAT
TTCAAGTTGTTGAAATAATACGAAGCTGACTAGCTTACGTGAATGATGTGCCCTCATTTGTTTTGGGTGAGGACTCATTACTG
CAGTATATTGATCTCTTCACCAAATGCTTTTTCTTTTTCTGAATAAATGCTGTATTAGAGGTTCTATTTATATATGATTTTTAAAA
CTTTGGTTTCCTTCTATCCACCCAAATACTGTGAATTGTTTTTCCATTTATTTTTCTTAGCTAATGTAACTTTATTCTTCACTTTTT
TTTAGCCCTAGACTTCCTACTAGTTTTCTGTGGCATTCTGTAGGACATTGTATTGCTTGGAAAAAAAAGATGTATTCATTCTTGGGG
CAAATGCTCTATTATCCTTATTTATGACAAGAGAATAATGAAATTCATAAGAAATTAATAACATTCAGATATTGCTATAAATGTAC
TTGAGTCATTTTCATTTGGGGATAGTAATAATGGCTGTGGCAGCTTAATGGAGAAACCTGTTGGCCTCTTTTTCTGGCATTAG
GATCTCTTGTCATAGAACTATTGGTAAAGTACAGGTTTGATAGCAGAGTTCCTGAATTCAGCATATCATCAGAATTTCCATTTACC
TTTTGTCTTTTCTTTTATTGTATTTTTAACCTTTTTGTTTCTACCTCCCATGAGTAACATTGATTTCTGCTGAAGTTA
GAATTTGTGTTAAGAATTGACTTTAAATTTCTGAAATAGTTGAATATTAGAAGTGGCTTCAGTTGCCATGAAATGATTGCTTTTCT
TTTTCTTTTTTTTCCTTAAATAAAATAATGCAGCCTTATATATGTCTCTTCCCCTCAAGAATGTGAATTTAGGCTGGGCATAGT
GACTCACGCCTGTAATCCCAGACCTTTGGGAGGCTGACACGGGAAGATTGCTTGAGCCCAGGAATTTCAGACCAGCCTGGGCAACA
CAGGAAGACTCCATCTCTACTTAAAATATTTTTGTTTTTTAGCCAGGTGTGGTGGTATGTGCCTGTAGTCCCAGCTACTTGGGAAG
CTGAGGTGGGAGGATCACTTGAACCCAGGAGGTTTGGGGTGCAGTGAGCTATGATTGCGACACTGCACTCCAGCCTGGGCAACAGAG
CAAGACCCTGTCTCAAAAAAAAAAAAAAAAAACAAAACTGATTAGCTCCAATTCCAAATGACTAACTCTTAGGCAGTCATAGC
CAATGAAATCATCTGACGGTAGCTTCTGTAGCCCTTAACCTAAGGAGTCATTAGAGGTTATAGTAAATTAGTTTCTCTAGTGGTGC
AGAGAGAAATGCCATCGGGGAAATTATCACTGTCTTTTTGGCTAAAGTTTTATATTGTGAACTGGATCCCACTTAACAGCTTAAAA
ACACAAAAATGAAAGGGTAGTCCTAGTTTATCTTCTTAATTAGAATCATTATTTGGAAATAAGATTTGCAATGTGCTGTCTATCCC
```

TABLE 1-continued

Sequences Table. First column: SEQ ID No. Second column: corresponding mRNA sequence. For the 3 different groups, see explanation in the text.

CAAACACTGCTGAGCTTGCTGGAAAACAGAATTTAACATGAATGTTGTCTGAAAGCTGTAGGATCAATGGCAAAAAGGGGAAATG
TTTGGTAGGGAATTGGACCAGTTCTAAGGTATCACTTTTAATTATAAAATAATGTCTTCCTTTTTATCTGCTTTTCAGACAGCCTC
AGTGAACTATTAAACATTTGTGTGCAAAGTCCTATTTTGCTTATCTAAGGCATTTTGACTTGGAAGTATTAAACTTCAGGAACGAG
CTAGAGAAGACAATGAGGGTATGTTAGAGAAGGAAAAATAGGAGCTTTTTGCTTATGGATTTTAGAGGTCCACAAATCGAAAGGAA
AAATAAATTTCTTCATTTCTAACCCTAAAATAATTTTGTTAATGAGATGCTGGGAAGAAGACTACCAAAAGGCCTCAAAGCTCATG
CTTCTAGAATATTCAGTAATTCTGAATAGTCTTTGGGAAGTAGCATTTCTTGGGAAGTAGCATTTCCCTTCTTCCAAATAACTGTT
TGAGATCTTAAAACAGAAAATCCAGTGTTAATGGGCTCTAGATCTTAAACTAGGTGAGCAGCTTCTTACATACAACCAGTTCCTTG
TTAAGGATCCAGCAGGAAAACCAGCCATAAAACATTTCAACATGCAGTTTGGGGGCTCCCTTGCTTATTCACTGAGTTTAAGCTCT
TGCTGCAACATAGCTCTGTACCATCTGGGATGCTAGCAGTCACAGCAGTTAGCTCAGATATCTGAGCTGTCTGCCACACAAAGCCT
GAGGAGATCATCATTCTTCAGTTTCATTCATTACTTAATGAATGCCAAATTAATTGGCAGGAAGAAGAAACACTGTGTGATATACT
GAACAAGCCTGTGTGCATGAATAAGGAGCCACTCAAAAAGCCAATTTTGAGCTTTATTTCTCCGTTGTTAACAAATCTCAAGAAAG
CCTTTGTTACAGTTTAGCTCATGTCATTTGGTTGGTTTTATTTTCTAGCCCTTTAACATAGGAGGAAAATTGTCATTTCATGTATA
ACTTGTAACACAGAATTGAACTGATACTAGTTTCCTTGCCTTAAATTAATTATATGTCATCCCAAGGGTCTCTGTTAATTCTGCTT
TGCCAAGCAATAATGAGATCTGGGTTTGGCATTAGAAGTATTTCATAATTTTGGTTTTTTATTTAGGTTTCCTCCACATCTGTAAA
GTGATTGATTAAATTAGAGGAGGCGTGTAGAATAAATCCCAATCCCATTGCAACTGGCAGAGCTTTATAAATCTTTATAAATTCAG
TTACAACAAAGGAGAGGATCCTACACCATTAGAGCCATGCCATCAGGTGTTTGCAAGTGACAGCTGTAGTGTGTTGCCTCAAATAA
TACCAAGTTATAAATAATACCAAGTAATTATCAACTCACTCCCAAATTATAAGATATCAAAGTCCAAAAGGTTACTTAGGAGTA
GTCTTCCGTGGGGAAGATAAATTTATTAAAGAGTCATGTACTGATCTTTTTCTTGGGATTTTTTTCCTTTCCCAGAAAAAAAAA
TTATTTTGGTGACTGATCAATTGTAAACAATTTTCTTCCTTACTTACAAATCATCCGTTCAGAAAAATAAAAGTGGACTTCCTTTC
CTAAGCATTACAATTAGCCTGGGCAAGAGGTGTTATGATTGTCTTATTCTTTAAGCCGGCTTACTTTTTGGATTTGTGTGAAATGT
CTTTTGAAAAGAAAGTAGATAGTATAGTATTAATTAACTACTTTGTATAGTCTTCTGCATAATTTAGAGTTGAAAATAATGTAACA
TTTTCCTGTGAACAGATTCCTTTATGCGTACATACTTTATAAATATACATACATACACATACACATACATTTTTAAAATGCTCTTT
TTAAAGAGATTCTTATCTTGCTCCCACTCCAAAAGCTATGTACAGTTGAGTTATTAGCCTCAGAGGAAGAGTACAGGAAAGTGAAG
ATGAGGACCTCCTTTTCTTGTGTTGGTCTTGGGAACAAACAGTATTCCGTCTTTCAAATATGGCATATTTCTAAACAGTTTGGGAA
AGATGTTAGAATTTTTTAAAAGTCAGCTCTTTTTATAAATTGGAAGTACTCAGTAGTCAGAAATTAAGATCCCCTCTGATAGAGATA
GATTCTCAAAACCAAAATTGGACTGAAAATTAGATTGAGAAGAAAGATACAACTTCCTCCATAGCCAATAAAATCTGTCTTTCCAA
GTCTGCTTATTAATGCTGTGAATCGCTCCTTCTGTTTGTGAAAACATCTCCTGGACTGGAAATGTGGTGCTGTAACCAGCTGAGCC
GAAAGTTGGAGAATGTTAAATATCTTATATGGGACTTACGATAAAATGTATTGATGTTAGTGATTGTCAAAATAGGTTTATCATTT
AAAAAACTAGGAAATTACTAAGTATAAGAAGAAAAACCAGTATTAATTAAGTGATGAGACCTGTTCATTTTGTTTTCCCTGACTT
ATTTCCATTACCAAACATAGTAAAGGCCAGAAAAGATTAAAAAAAAAATTAACACAGCCATTCCATTGTTTTTTACCACATGGAGA
AAGGACCAGGCTGGAAGCATATGTCCCCCCACCCTTATTTATATTCCTTTGAGCATTGCCGTTTTCTAGACAGACAATCCGAAAAT
AATTGTGTTGATAGGTCTGTTTAAGCCTGAACTCTGGGTGTAAAATGTTATCCAGAAGCTATAGGGAGCTGCCTTGCTCAGGTCAT
TGGAAATTTCAACCCTAAGACTCATTGGAATTTCTAAGTCCGTTATGCACCATTATGGGCATATGGAGCATATTCATACCATGAGG
AGGAGTCTTTGTTTATGATGGACTTTTTAATATGGCCATAATTAAACTCACACTCAAAAAGGATGAGCTATTGTCAAAAGCCAAAA
GAAAAACAGACAAAATGAACATGAAGCAAGGAGTCCATAAAACAAGAGTTCTTTACCACGTTTAAGCAAATGTCTCTCAAAAAAAA
TTGTATTTCTGTGCACATTAGCTGAGATTCACACATTTTGCACCTCAGTAGTATTTCAGATGAGACTCAATGTGTGGAGAAAACTG
CTAACTTGTTTGGTTCTACTCTTACCCCCTCTTCTGTGGCAATGTGGGTCAGGGCCGTATCCTAAAGTATCCACATGGTCTTAAA
TGGAAATCATGGGACTCTGGAAAGCTGGCATGAGCTGGTTGGAGCTTTTAAACAGAAGTGCTTTATGGGTATCAGATCTCTTCTGA
CATCAATTGTTTCAAATCATTGTTGGGCTCTGTCGTGTTCTGCAATCTTCCCCATTCCCCTCATGATCTCTGGCTTATCTTTTATC
CAATCTGTATGGACTTTTTAGGATTTTTTTTTCTTATAGTACAAATAATTTTCAGATCCCAGCTTTGGTAAATGTGTTAATTCTA
CTTTGTGAATAAATAAATGAGTGATCTGCTAAAAATGGCAATTGTAGAATTATGTTGTATGTAATGTACATATGGAGAAAGAATGT
ATTTTGTTCATTTTCTTAATAAAATGTTATATATGGATGCTAAAAAAAAAAAAAAAAAAAAA

59 GAGGTAGAGGAAAGGTCTTGACGGGGTGGCTGGATCCGTGGCAGAATCCAGTTCCAGATTCTAGACTTGAGGGTTCTGGGCTGTTG
GTCTGTAGAAGCGAAGGAGAGAAGGACTCAAATCCAGGCCAAGTGTATGGCTGTCTGAGGTATTGGAACAGAAGGAGGTCCATTCC
TGTTGGTGACAACACCGTGGCCCTGTTCTGGGATGAGCAAGGTGTAAAGGTTTCCCCCAAGAAAGAGCAGCTGAGTCCTTGCATCT
TGTGGCAGCTGGTGTGCCCAGCACTGAGTCTGTAGGAGCTGAAGCCAGCCCGGACCCTTCTCATGGGCAGTGCCCACCTGTGCTGA
AGTCCTGCAGCGGTGGCGGTGTGAGGAGCTGTGAAATTAGTTGTAACTGAAAATGTCTGACGGTCTGGATAATGAAGAGAAACCCC
CGGCTCCTCCACTGAGGATGAATAGTAACAACCGGGATTCTTCAGCACTCAACCACAGCTCCAAACCACTTCCCATGGCCCCTGAA
GAGAAGAATAAGAAAGCCAGGCTTCGCTCTATCTTCCCAGGAGGAGGGGATAAAACCAATAAGAAGAAGGAGAAAGAGCGCCAGA
GATCTCTCTTCCTTCAGACTTTGAGCATACGATTCATGTGGGGTTTGATGCAGTCACCGGGGAATTCACTGGAATTCCAGAGCAAT
GGGCACGATTACTCCAAACTTCCAACATAACAAATTGGAACAGAAGAAGAACCCACAAGCTGTTCTAGATGTTCTCAAATTCTAT
GATTCCAAAGAAACAGTCAACAACCAGAAATACATGAGCTTTACATCAGGAGATAAAAGTGCACATGGATACATAGCAGCCCATCC
TTCGAGTACAAAAACAGCATCTGAGCCTCCATTGGCCCCTCCTGTCTGAAAGAAGATGAAGAGGAAGAAGAAGAAGAAGAAGAATG
AAAATGAGCCACCACCAGTTATCGCACCAAGACCAGAGCATACAAAATCAATCTATACTCGTTCTGTGGTTGAATCCATTGCTTCA
CCAGCAGTACCAAATAAAGAGGTCACACCACCCTCTGCTGAAAATGCCAATTCCAGTACTTTGTACAGGAACACAGATCGGCAAAG
AAAAAAATCCAAGATGACAGATGAGGAGATCTTAGAGAAGCTAAGAAGCATTGTGAGTGTTGGGGACCCAAAGAAAAAATACACAA
GATTTGAAAAAATTGGTCAAGGGGCATCAGGTACTGTTTATACAGCACTAGACATTGCAACAGGACAAGAGGTGGCCATAAAGCAG
ATGAACCTTCAACAGCAACCCAAGAAGGAATTAATTATTAATGAAATTCTGGTCATGAGGGAAAATAAGAACCCTAATATTGTTAA
TTATTTAGATAGCTACTTGGTGGGTGATGAACTATGGGTAGTCATGGAATACTTGGCTGGTGGCTCTCTGACTGATGTGGTCACAG
AGACCTGTATGGATGAAGGACAGATAGCAGCTGTCTGCAGAGAGTGCCTGCAAGCTTTGGATTTCCTGCACTCAAACCAGGTGATC
CATAGAGATATAAAGAGTGACAATATTCTTCTCGGGATGGATGGCTCTGTTAAATTGACTGACTTTGGGTTCTGTGCCCAGATCAC
TCCTGAGCAAAGTAAACGAAGCACTATGGTGGGAACCCCATATTGGATGGCACCTGAGGTGGTGACTCGAAAAGCTTATGGTCCGA
AAGTTGATATCTGGTCTCTTGGAATTATGGCAATTGAAATGGTGGAAGGTGAACCCCCTTACCTTAATGAAAATCCACTCAGGGCA
TTGTATCTGATAGCCACTAATGGAACTCCAGAGCTCCAGAATCCTGAGAGACTGTCAGCTGTATTCCGTGACTTTTTAAATCGCTG
TCTTGAGATGGATGTGGATAGGCGAGGATCTGCCAAGGAGCTTTTGCAGCATCCATTTTTAAAATTAGCCAAGCCTCTCTCCAGCC
TGACTCCTCTGATTATCGCTGCAAAGGAAGCAATTAAGAACAGCAGCCGCTAAGACTGCAGCCTTACACCTCACCATCTCCCTCA
TGAGTAAGACTGAAATAAAACTCTGCTGCAGGAAAGATGGAAGAAAAAGACAGTCAAATGGGGTGGGGTTCTTTACCTTTCAAATG
AATAGAAACTTCTTATAAGCCTTTTTCCTACTCCCTCAGATTATGTAATTTATTTGTAAGCCTGAATCGCAGCCCAAACAGGGCAG
CAATGTTGAAGTGACCATAAAGTGGTCACTTCCACCGTGAAGCGAAAGAGCCAGTAGTGAATCCCCTCATTTTGTGCATTCACTTT
GAAGAAAAAGGTTTCTCAAAGATGCACACTCCCTCTTCATAGTGTTGTGTTTGTTTTAAGTTAGAGAGTAGTCCCTCCTTGCATTC
AAACCTCCTTCAAAACTCCTTACCCAATGTGATGTTTTTCACTTGCATTGTCATTAGATGTCCAGAAAAAAAAAAGATGTCAAAAT
GTTTTTCTAAAAAAAGAAAGCA

60 ATAACGGCGCTGGCCCCGCCCCTTCTCGAGAACTCGCAGAGCTGGGCTGGTAAAATTGCAGTGCTGAAGACACTGGACCCGCAAAA
GGCTGTCCCTCCCAAACCTGGGATTCTGGGCTCACTGAGTTCACCTGCGAGTCAGCCCTACCTGCACTGCTCTGGTCTAGTACAAA

TABLE 1-continued

Sequences Table. First column: SEQ ID No. Second column: corresponding mRNA sequence. For the 3 different groups, see explanation in the text.

|    |    |
|----|----|
|    | CAGGCTGCTGGCATTGAGGGACGGAGTCTCCAACTCCTGGCCTCTAGCAGTCCTCCTGTGTAGGTCTCCCAAAGTGCTAGTGTGTC<br>CGGAATTGGTGGGTTCTTGGTCTCACTGACTTCAAGAATGAAGCCGCGGACCCTCGCAGTCTGCTACAATGCTGCTGCTGCACAGA<br>GCTGTGGTCCTCAGGCTCCAACAGGCCTGCAGACTCAAGTCAATCCCCTCAAGGATCTGCATTCAGGCCTGCTCCACAAATGATTC<br>ATTTCAGCCCCAGCGCCCCAGCCTCACCTTCTCTGGTGATAACTCCAGCACCCAGGGATGGAGAGTCATGGGGACCCTATTAGGTC<br>TCGGTGCAGTGTTGGCCTATCAGGACCATCGGTGTAGGGCTGCTCAGGAGTCAACACACATATACACTAAGGAGGAAGTGAGTTCC<br>CACACCAGCCCTGAGACTGGGATCTGGGTGACTCTGGGCTCTGAGGTCTTTGATGTCACAGAATTTGTGGACCTACATCCAGGGGG<br>GCCTTCAAAGCTGATGCTAGCAGCTGGGGGTCCCCTAGAGCCCTTCTGGGCCCTCTATGCTGTTCACAACCAGTCCCATGTGCGTG<br>AGTTACTGGCTCAGTACAAGATTGGGGAGCTGAATCCTGAAGACAAGGTAGCCCCCACCGTGGAGACCTCTGACCCTTATGCTGAT<br>GATCCTGTACGTCACCCAGCCCTGAAGGTCAACAGCCAGCGGCCCTTTAATGCAGAGCCTCCCCCTGAGCTGCTGACAGAAAACTA<br>CATCACACCCAACCCTATCTTCTTCACCCGGAACCATCTGCCTGTACCTAACCTGGATCCAGACACCTATCGCTTACACGTAGTAG<br>GAGCACCTGGGGGTCAGTCACTGTCTCTTTCCCTGGATGACTTGCACAACTTTCCCAGGTACGAGATCACAGTCACTCTGCAGTGT<br>GCCGGCAACCGACGCTCTGAGATGACTCAGGTCAAAGAAGTAAAAGGTCTGGAGTGGAGAACAGGAGCCATCAGCACTGCACGCTG<br>GGCTGGGGCACGGCTCTGTGATGTGTTAGCCCAGGCTGGCCACCAACTCTGTGAAACTCTGTGAAACTCTGCTTTGAGGGACTGG<br>ACTCAGACCCTACTGGGACTGCCTATGGAGCATCCATCCCTCTGGCTCGGGCCATGGACCCTGAAGCTGAGGTCCTGCTGGCATAT<br>GAGATGAATGGGCAGCCTCTGCCACGTGACCACGGCTTCCCTGTGCGTGTGGTGGTTCCTGGAGTGGTGGGTGCCCGCCATGTCAA<br>ATGGCTGGGCAGAGTGAGTGTGCAGCCAGAGGAAAGTTACAGCCACTGGCAACGGCGGGATTACAAAGGCTTCTCTCCATCTGTGG<br>ACTGGGAGACTGTAGATTTTGACTCTGCTCCATCCATTCAGGAACTTCCTGTCCAGTCGGCCATCACAGACCCCGGGATGGAGAG<br>ACTGTAGAATCAGGGGAGGTGACCATCAAGGGCTATGCATGGAGTGGTGGTGGCAGGGCTGTGATCCGGGTGGATGTGTCTCTGGA<br>TGGGGGCCTAACCTGGCAGGTGGCTAAGCTGGATGGAGAGGAACAGCGCCCCAGGAAGGCCTGGGCATGGCGTCTGTGGCAGTTGA<br>AAGCCCCTGTGCCAGCTGGACAAAAGGAACTGAACATTGTTTGTAAGGCTGTGGATGATGGTTACAATGTGCAGCCAGACACCGTG<br>GCCCCAATCTGGAACCTGCGAGGTGTTCTCAGCAATGCCTGGCATCGTGTCCATGTCTATGTCTCCCCATGAGCATGGAAAGGAGC<br>CACCTCCACCCCTTTCCCCACCCATTAGCCTCACTGCTTCAGAAAAATCTTTCCCACCTTTCAACTTCTTGGATCACAACTCTGGC<br>CTTCCTAAGCCATACCCAAGTACACATATAGCACATTTCACCCAAGGACCTTCCCTCTTTGGACACTATGTTACATACCCCTCTTG<br>GCCTTTGAACCTGTGCCAGGAAGTGTGAGCTGTTACAGCAAGGGGCTAGAAGTGAAAAAAGTAATTCTGGAGACAAGCACTATTTT<br>CTCTTCCTACCCCACCTCCATTTCTAATGCCTACTGCCATCAAGGCCTTGTTTTGCTTTTCTTTTTGGATTGTTCAGAGAAATGTG<br>TGTGGCATGTGTAAGAAAAGTGTATATACTATCTTATACTACCTCTCCAGGTTGCCAGAGAGTTGCGAGGAGAGCAAGGGGCACAA<br>CCGTCTCCCTTTATAGTTCTACTTTTCTAATAAATAGTCTGTTTAAGATCATAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAAAAAAAAAAAA |
| 61 | GGGCTCGGGGTCCGCCCGCGGGCTGCCGGTGCGAGCGGGCGGCCCGGCTCCCCTCCTCCCCCGCCCGCGCCGCCGCTGTGATTGG<br>GTGGAAGATGGCGCTGGCCGGATGGAAATCCTAATGACAGTCTCCAAATTCGCCTCCATCTGTACCATGGGCGCCAATGCTTCGGC<br>ATTAGAGAAAGAGATTGGTCCAGAACAGTTTCCGGTCAATGAGCACTATTTTGGATTAGTCAATTTTGGGAATACCTGCTACTGCA<br>ATTCAGTTCTTCAAGCACTTTATTTTTGTCGTCCATTTCGGGAAAAAGTTCTTGCGTATAAGAGTCAACCTAGGAAAAAGGAGAGC<br>CTTCTTACATGCTTAGCAGCTCTTCCATAGCATAGCCACTCAGAAGAAAAAGTTGGAGTAATACCCCCTAAGAAGTTCATCAC<br>AAGATTACGGAAAGAAAATGAGCTTTTTGACAACTACATGCAACAAGATGCCCATGAATTCTTAAATTACCTACTAAATACAATTG<br>CTGATATTTTACAAGAAGAGAGAAAGCAGGAAAAACAAATGGTCGTTTACCTAATGGTAATATTGATAATGAAATAATAACAGC<br>ACACCAGACCCAACGTGGGTTCATGAGATTTTTCAGGGAACATTAACTAATGAAACCAGATGTCTTACTTGTGAAACTATAAGCAG<br>CAAAGATGAAGATTTTTTAGACCTTTCTGTTGACGTGGAACAAAATACATCAATTACTCACTGCTTAAGGGGTTTCAGCAACACAG<br>AAACTCTGTGCAGTGAATACAAGTATTACTGTGAAGAGTGTCGCAGCAAACAGGAAGCACACAAACGGATGAAAGTTAAAAAACTG<br>CCCATGATTCTAGCTCTACACCTGAAGAGATTTAAATATATGGATCAACTTCATCGATATACAAAACTCTCTTACCGGGTAGTTTT<br>TCCTTTAGAACTTCGTCTGTTTAACACTTCAGGTGATGCCACCAATCCAGACAGAATGTACGACCTTGTTGCTGTTGTGGTTCACT<br>GTGGAAGTGGTCCCAATCGAGGCCATTATATTGCAATAGTTAAGAGTCATGATTTTTGGTTGTTGTTTGATGACGACATTGTAGAA<br>AAAATAGATGCACAAGCTATTGAAGAATTCTACGGGTTGACATCAGATATCTCAAAGAACTCTGAGTCTGGTTACATCCTTTTCTA<br>TCAGTCTCGGGACTGAGAGGGAACCGTGATGAAGAGACACTTTCTGCCTCATTTCTTCTCTGGTTATTTTGGAAAGGATCAAGCAC<br>TGATTTTCAAGAAAAGAGAAATGCAGGAAGCTCAGGGGGCAGTAGCACACTTTGCACACGATAAAGCAAAGACGATGGATTGACA<br>AGCCCTTCCGATCATGGTAGTTGATTTATTTGCTCAGGTATCATGCTGTCTGTACAGTTCCATACAACAAGGAGGTGAAATCAGAG<br>ATACCAGCTCCTCTTTTAAAACAGCCTTCCAGTCATTGGCACGCATTTTCTCTTTATTAATTGCACCAATAATGCTTTGAATTCCT<br>TGGGGGTGCAGTAGAAAGAATCGGAATCTGTGCCGTATTGATAAGGAGTGATGTTGAACACACTGCATAAATTTGCCTGGTTCAG<br>TATGTATAGAAGGCATATTCAGTGGTCTTTTCAAGAGTAAACCAGAAATACTTTTGGGCCCAACACTTGCAGTTGCCTTCCTGATG<br>TAAAAACTAACATGCTAGATAATCCAGTGTCGGGAAGACAAAGATGTTTTGCTTCTCTGAAGAAGCTTATAATAATATACAGTATA<br>TGTATATGTAGGGAGCAATTGGTCAAAAGTGGCTTTTTGTTTCCCCAAGGGAAAGACTGGCTTTGTAATTATAATTTTTTCCTTAT<br>TTATTTTACTTAAAACTGGTAGAGTCTAAGTATTATATGAAGTGCCCATGATTCTGTCAGTAAATTTGAACATATTTTTATTAGTT<br>AATGTCAGTTTAAGTTGTCCTTTTGTTTGTTTCTATTTTTAAGGTGAATTTTAATTTCTATCTGAAATCAGTTAAGATACCTTGAG<br>AAAAACTGCAGTGAGAGGAGATAAATATCCTTTTTCAGGAGGAACTCAATGATCTCTGGCTAAATATTTGTCCTTTTATTATGGTTTC<br>TAAATCAGTTATTTTCTTCAGCTTTAATTTCATAAAATTAAAAAACTATTTTAAAAATTCCTGTAGTTGTTGGAATAATTAAAAAT<br>TCTGGTGCAGTGGTGGTATACCAATCTTTAGAATTCTTAAGTATTCTAATGTTTCAAGTTGAGATCATGCTTGGGAAATCATGTC<br>ATAGCATTTATGTTATTTCAGATGCCATTTTTACCCTGGAAAGAAGTCATAATGTTCATCATAACCCTAGCAGCCTGGATAGTG<br>AGCTAAACAAACCCTTCAAAGATTAAATTTTAATCAAGTAGACCGGGAATACAAAAGACAAGTCCTTCCTTCCCTTCCCCCCACCT<br>TTACAAATCTTACTGGAAGGGTGTTCAGAAATTAAAATCTGTGTTTGCTAAGACTTCATTCTGTTGGGGGTTTTAAGAAGTAATAT<br>ATGTAACATAAAATATATGTAAACGATTGCAGTTTTTTTGGACGTTTTTCCATGCATCAGTAAGTTGTCTGACAGTAGCCAAATGT<br>AACTTGCAGAAAATTATTGAAAATTATATTCAGAATAATAGCAATCAGGCCTTGGATGTTCTTTATTAAACTCTTTTCAGGCAGTA<br>AATTTAAAAAAAATTGTCATTTTCTAAAGTCCTTTTGCTAAAACTGTTGACTATGGAAAACAACAAAAAGGAATTTTTAGTCTGC<br>TGCTATTATTAACATTTATATCTGTATCTTTTGGCTCAGGAAATGACTTCACCTATTTTTTCCATAAGCAGACCTTTAACAGAGT<br>CACTTAATTGGGCTGCTTAAACGGATGTTCTGGGAGAAAATTATAATATTTAGTATTTGTACAAAATATCAAAAGTATTTTGACA<br>AGTTTCTTTTTAAGATAGTTCCTAAAGCCTTACCCTGGCTAGAGGTGTTTTGTACAAATTATATATAAGCCAGCCTGATCTACCAA<br>CATGCCACAGAGAATCACAATCAACAGTGTGGGGAAAGTCAGGGCAGTGGAAGTGGATGCACTCTTTTTATTTTGAAGGCTTAAAC<br>CAAATTGTCTTGGAATTAAAGCTGTATTTCTGCAGCTTTCGGTACAGAAGAAATGACTGTGGATGGGAAAGTGAAGCTGTGTCAGTTTTAACATT<br>AGCTATATCAACATGTTTAAGAAAGATAGATGAAGTCATTTGCATAAAGGTACAGCATTGAAATACTATGTTGTGTTTGTTTTTAC<br>ATTTTTGCATTAAAAAAAAACATGCCGTAAAAGCCAAGTTAAATTTCATATTAAAGCAAGTTCTAGTGTATGTGTTGAGTTCCTGG<br>TAATCACATACTTGTTCACATCTACACCGTACTTCATAGTATGATTTGTCAGGGAGGGATTGTGGGTGACAGTTTTACATTTAC<br>TTTTTCTTCTTAATGCAGCTGGATCTAAGTAAAGTGTTTTGAAGTTTGACAAAACTAAATGTACTTTTAAAACGTATAGGGTCAG<br>GGTTGGGGGAAAAATACAGGTATGTAAGTAAGAAAAGTGACCCATGAAGAAAGCATCGTGAGGTTGTATGTTGGTTGACTGTGAT<br>TAAAATGCGGGGCTGGTGTAAGTTGTAAGTGGTGGCTGATTGCCGTGTAACTATGTACATGATTGTTGGGATGGCTGTCCCATATT<br>TTGTATATTGGAATAAAAATTTCTATAAATTATTGTAACTAAAAGTAAAATATTCTAAATTAAGTCCCACTTCTTAAGTCACATGGC<br>TTCTGTCTTGGAAATTTTACCTTTAAAAGATTATTTAAGACAGGAACCAGGAGGCTTGGGAACAGGGAAAGAGGGAAATGTTGTAT<br>TATGTGGGTCTTGGGGCCTCTAACCATCAGTATAGGGTTTTTTCTTTCCTTGATGGCAGTAGAAAGACCTCATTTTCATAACATAA |

TABLE 1-continued

Sequences Table. First column: SEQ ID No. Second column: corresponding mRNA sequence. For the 3 different groups, see explanation in the text.

CTACTCTTGATACTTTCTTTAAAAACACTTTTTATTAAAGATTCTATCATGAGGTATTTGGCTGGGAGCTGGGAGGCTAAAGCGCT
CATGTCCTGGCTCTTCAGTGAATTTAACTGTGTGACCTTGGGCAAGTCACTTAACCTCTCTGTGCTTCAGTCTCCCTGTCTTGTAA
AATGGGAGTAATACCTACCTCACAGGGTTGTTGTGGGGATTAATTAGAGATAATGTCTGTAAAGCATTTAAGGTTCTTGAAGAAGG
CACTATATAAATACAAAATAATATCTATTAAAGTTGGTTTATTTGTGA

62 ACTCAACCTCCCCCGGAACTCAACCCCCGTCGCTCGAGTTTCTTTCGCTTCCGTCGGGACTCTGCGGAGTGGACCCGAGTGAACAC
AACTTCCGGCCCCACTGAGCGGTGTCCTGAGCCGATTACAGCTAGGTAGTGGAGCGCCGCTGCTTACCTGGGTGCAGGAGACAGCC
GGAGTCGCTGGGGGAGCTCCGCGCCGCCGGACGCCCGTGACCATGTGGAGGCTGCTGGCTCGCGCTAGTGCGCCGCTCCTGCGGGT
GCCCTTGTCAGATTCCTGGGCACTCCTCCCCGCCAGTGCTGGCGTAAAGACACTGCTCCCAGTACCAAGTTTTGAAGATGTTTCCA
TTCCTGAAAAACCCAAGCTTAGATTTATTGAAAGGGCACCCACTTGTGCCAAAAGTAAGAAGAGAACCTAAAAATTTAAGTGACATA
CGGGGACCTTCCACTGAAGCTACGGAGTTTACAGAAGGCAATTTTGCAATCTTGGCATTGGGTGGTGGCTACCTGCATTGGGGCCA
CTTTTGAAATGATGCGCCTGACAATCAACCGCTCTATGGACCCCAAGAACATGTTTGCCATATGGCGAGTACCAGCCATTTTCAAGC
CCATCACTCGCAAAAGTGTTGGGCATCGCATGGGGGGAGGCAAAGGTGCTATTGACCACTACGTGACACCTGTGAAGGCTGGCCGC
CTTGTTGTAGAGATGGGTGGGCGTTGTGAATTTGAAGAAGTGCAAGGTTTCCTTGACCAGGTTGCCCACAAGTTGCCCTTCGCAGC
AAAGGCTGTGAGCCGCGGGACTCTAGAGAAGATGCGAAAAGATCAAGAGGAAAGAGAACGTAACAACCAGAACCCCTGGACATTTG
AGCGAATAGCCACTGCCAACATGCTGGGCATACGGAAAGTACTGAGCCCATATGACTTGACCCACAAGGGGAAATACTGGGGCAAG
TTCTACATGCCCAAACGTGCTGTAGTGAGTGTAGGAGATAACTGTATATAGGCTACTGAAAGAAGGATTCTGCATTTCTATTCCCCT
CAGCCTACCCACTGAAGTCTTTGGGTAGCTCTTAAGCCATAACTAAGGAGCAGCATTTGAGTAGATTTCTGAAAAACAATGTTATT
TGTTGATTTAAAAGAAAACTGTATTTTTATTAAATAAAATTTAAACATCACTTCAGGAAAAAAAAAAAAAAAAAAAAAAAAAAAAA
AAAAAAAAAAAA

63 GTAGAGCTGGTTCCTGCTCGCCGCGGTGCCGCGCGCGCCGGCCGGCCGCTGGGCGCTCCGCGCTCCCAGCCTCGAGTTGTGCAATC
CTTTGTAGCACGCCAGAGTCCTCCTCCTCCGCTGTTGCCTCTCGCCCTCTCTCTTTTTTTTTTTTCAAGCTGTGAGCTCAACCGAT
GAGTCAGAGCCGTGCAATCCTGACACTGCATCGCAGGACTGGGGGTGACACGGAGGGAGGCAGAGCGCTCGCGAGGCGGACGGCAC
GGGTGCGGGGCGCGCCGAGGCTCCTGCATCGCAAGCGGGGGGTGACAGCCCGCGCGTCCCGCCCGGGCCTGCCAGCAAACTTCTC
AGCCTCGGGAGGCGCGGGCTGGCGGAAGCCCCGCGAGCGCCGCGGGGAGGCGACGGCGCCTGTTTGTTTTTAAAATCGGGAGTGCG
TGCAGGCGGCTGGAGTCCCGGAGGCGACCGAAGGCGGCGACCCGCGGCGGAAGGGGACAGCCGAGCCCGGAGCCCGGAGCCCGGG
CAAGAGCTGGGTGCCAGAACCCTGTGGAGCATCATGAACTGGGAAGAGTAGCTGAGCCCCAGAGCCTCTCTGGAAGAGAAAGGAAG
AGCCAGCAGTTCTTTCTCCCAGTGTCCGACCTCACTGTCCAGCCGTCTTCCTCTGCCCCTGCTCTGCCCTCCCTGGCTCTGGACTA
GAGCCCGGCTTCCAGCAGGACGTTTCCCCAGGGGATGGGCGACTGTTGAAGGGGATCTCACCGCCAGGGCTCAGTTGGCCACATCA
TGAACCTCCAGGCCCAGCCCAAGGCTCAGAACAAGCGGAAGCGTTGCCTCTTCGGGGGCCAGGAACCAGCTCCCAAGGAGCAGCCC
CCTCCCCTGCAGCCCCCCAGCAGTCCATCAGAGTGAAGGAGGAGCAGTACCTCGGGCACGAGGGTCCAGGAGGGGCAGTCTCCAC
CTCTCAGCCTGTGGAACTGCCCCCTCCTAGCAGCCTGGCCCTGCTGAACTCTGTGGTGTATGGGCCTGAGCGGACCTCAGCAGCCA
TGCTGTCCCAGCAGGTGGCCTCAGTAAAGTGGCCCAACTCTGTGATGGCTCCAGGGCGGGGCCCGGAGCGTGGAGGAGGTGGGGGT
GTCAGTGACAGCAGCTGGCAGCAGCAGCCAGGCCAGCCTCCACCCCATTCAACATGGAACTGCCACAGTCTGTCCCTCTACAGTGC
AACCAAGGGGAGCCCGCATCCTGGAGTGGGAGTCCCGACTTACTATAACCACCCTGAGGCACTGAAGCGGGAGAAAGCGGGGGGCC
CACAGCTGGACCGCTATGTGCGACCAATGATGCCACAGAAGGTGCAGCTGGAGGTAGGGCGGCCCCAGGCACCCCTGAATTCTTTC
CACGCAGCCAAGAAACCCCCAAACCAGTCACTGCCCCTGCAACCCTTCCAGCTGGCATTCGGCCACCAGGTGAACCGGCAGGTCTT
CCGGCAGGGCCCACCGCCCCCAAACCCGGTGGCTGCCTTCCCTCCACAGAAGCAGCAGCAGCAGCAGCAACCACAGCAGCAGCAGC
AGCAGCAGCAGGCAGCCCTACCCCAGATGCCGCTCTTTGAGAACTTCTATTCCATGCCGCAGCAACCCTCGCAGCAACCCCAGGAC
TTTTGGCCTGCAGCCAGCTGGGCCACTGGGACAGTCCCACCTGGCTCACCACAGCATGGCACCCTACCCCTTCCCCCCCAACCCAGA
TATGAACCCAGAACTGCGCAAGGCCCTTCTGCAGGACTCAGCCCCGCAGCGCTACCTCAGGTCCAGATCCCCTTCCCCCGCC
GCTCCCGCCGCCTCTCTAAGGAGGGTATCCTGCCTCCCAGCGCCCTGGATGGGGCTGGCACCCAGCCTGGGCAGGAGGCCACTGGC
AACCTGTTCCTACATCACTGGCCCCTGCAGCAGCCGCCACCTGGCTCCCTGGGGCAGCCCCATCCTGAAGCTCTGGGATTCCCGCT
GGAGCTGAGGGAGTCGCAGCTACTGCCTGATGGGGAGAGACTAGCACCCAATGGCCGGGAGCGAGAGGCTCCTGCCATGGGCAGCG
AGGAGGGCATGAGGGCAGTGAGCACAGGGGACTGTGGGCAGGTGCTACGGGGCGGGATTGATCCAGACACGCACGGAGGCGCCGG
GCATCCCAGGAGGCCAATTTGCTGACCCTGGCCCAGAAGGCTGTGGAGCTGGCCTCACTGCAGAATGCAAAGGATGGCAGTGGTTC
TGAAGAGAAGCGGAAAGTGTATTGGCCTCAACTACCAAGTGTGGGGTGGAGTTTTCTGAGCCTTCCTTAGCCACCAAGCGAGCAC
GAGAAGACAGTGGGATGGTACCCCTCATCATCCCAGTGTCTGTGCCTGTGCGAACTGTGGACCCAACTGAGGCAGCCCAGGCTGGA
GGTCTTGATGAGGACGGAAGGGTCCTGAACAGAACCCTGCTGAGCACAAGCCATCAGTCATCGTCACCCGCAGGCGGTCCACCCG
AATCCCCGGGACAGATGCTCAAGCTCAGGCAGAGGACATGAATGTCAAGTTGGAGGGGGAGCCTTCCGTGCGGAAACCAAAGCAGC
GGCCCAGGCCCGAGCCCTCATCATCCCCACCAAGGCGGGCACTTTCATCGCCCTCCCGTCTACTCCAACATCACCCCATACCAG
AGCCACCTGCGCTCTCCCGTGCGCCTAGCTGACCACCCCTCTGAGCGGAGCTTTGAGCTACCTCCCTACACGCCGCCCCCCATCCT
CAGCCCTGTGCGGGAAGGCTCTGGCCTCTACTTCAATGCCATCCATCTACAACCAGCACCATCCTGCCCCTCCTCCCATCACGCCTA
AGAGTGCCCATCGCACGCTGCTCCGGACTAACAGTGCTGAAGTAACCCCGTCCTCTCTGTGATGGGGGAGGCCACCCAGTG
AGCATCGAGCCACGGATCAACGTGGGCTCCCGGTTCCAGGCAGAAATCCCCTTGATGAGGGACCGTGCCCTGGCAGCTGCAGATCC
CCACAAGGCTGACTTGGTGTGGCAGCCATGGGAGGACCTAGAGAGCAGCCGGGAGAAGCAGAGGCAAGTGGAAGACCTGCTGACAG
CCGCCTGCTCCAGCATTTTCCTGGTGCTGGCACCAACCAGGACCTGGCCCTGCACTGCTGCACGAATCCAGAGGAGACATCCTG
GAAACGCTGAATAAGCTGCTGCTGAAGAAGCCCCTGCGGCCCCACAACCATCCGCTGGCAACTTATCACTACACAGGCTCTGACCA
GTGGAAGATGGCCGAGAGGAAGCTGTTCAACAAAGGCATTGCCATCTACAAGAAGGATTTCTTCCTGGTGCAGAAGCTGATCCAGA
CCAAGACCGTGGCCCAGTGCGTGGAGTTCTACTACACCTACAAGAAGCAGGTGAAAATCGGCCGCAATGGACTCTAACCTTTGGG
GATGTGGATACGAGCGATGAGAAGTCGGCCCAGGAAGAGGTTGAAGTGGATATTAAGACTTCCCAAAAGTTCCCAAGGGTGCCTCT
TCCCAGAAGAGAGTCCCCAAGTGAAGAGGAGCTGGACCCAAGAGGGAGCGCCTGCGAGGCAGCAGGGAGGGGAGGGGAGGGGTGC
CAGAGATCCAAGAGAAGGAGGAGCAGGAGAGAGGAGAGCGCAGCAGGCGGGCAGCGGCAGTCAAAGCTGCCAGACACTACG
GCCAATGAGTCGGCCAGTGACATCCTCATCCTCCGGAGCCACGAGTCCAACGCCCCTGGCTCTGCCGGTGGCCAGGCCTCGGAGAA
GCCAAGGGAAGGGACAGGGAAGTCACGAAGGGCACTACCTTTTCAGAAGAAGAAAAAAACAGAGACATTCAGTAAGACCCAGA
ATCAGGAGAACACTTTCCCCTGTAAAAAATGGCAGGTAAGGTGGGCAGCCGTGTCCCCGCTGGGACCCCCGCAGGGCTGGCGC
GGAGGGGGCGGGGTGGGGTGGAGGGGAGGGGAAGAGGTACAGGCGGTGTCCGCCTCGTTTCTGGTTGGCTCAGCGGGTTTCTAG
GGTTGTGACGTCATGGGGCAGCTTTCGGAAAATGACGCGAGCTGCCGGCCGCGGCTGTGCAGCGTGGGGTGAAGGTGAAGGCTG
GGGCTCCTCGCGCACCCGCGCTGGGGCCCCGGGTGGGCTAGGCCGGTTCTGAGCAACCCCCACCCGGCTGCAGGGTGTTTTACA
AGGTGAAGAGCCAGTGCGCATATGAAGAGCCACGCAGGACAGGAAGAGGCTGCAGCGCTGAGGCTGAAGGAGAAAGAGGCC
GCTGCTGCCGCCGCCGCCGCCCACCAGCAGGCCCTGCGGGAGGAGAGCGGTGCGGGCGACAAGGGCTGAGCGCGGGAGCCAGGCTG
GCCCAGTCCTGGGCCTCGGCCCTTCCCGCACCGCCGCCAGCGCCCGCAGACACCCTGGCATCTCAAGAGGGAGTGAGGAGAGGATT
GCAGGGACTTTTCCCTGCGAAACAAATGAGACAATGACATAAACGGCTCTTTTATTTATGAAGGCCCTGGGAGCAGCGTTAAGGGC
TCCAGGATCCAGCTCTCTTTGCATTTGGTCTGTCGGAAGCTGTCCTCGTGCTTTCCTGGACCGGGAGAGTCCCGTCCCCTCGGGA
GGGACTCCACCGCCTCTCACACTCCGATTTCTGCTGCTCTGCTGCCCCGCAGTCTTTTCCCTTTATTTGCTTCCCCCTCCTCCCCT

TABLE 1-continued

Sequences Table. First column: SEQ ID No. Second column: corresponding mRNA sequence. For the 3 different groups, see explanation in the text.

```
   CGGCCTCCAGGAAGCCACCGTGGCCGGCCAAGCACAAGCTCACCCACTTTGGAGCAGCATTTCTCCTCCCCAGAGGACCTCGAAGG
   CTGCAACGGCCCTGCCCCAAGCCCCAGAAAAAGAAACTCTTGGAGGGAGTCTGCGGGCTTCTCTGAGAAGGGGCGCAGCCTGACAC
   CTGTGCTGTCCCTGCAGTCTCTAGGCCTGTCTGAGCTGCTCCCGTGACCGTGTCCTGAGTGGCCACCTCCTCCTTGGGAGGGAGGC
   CGCGGCAGGTACTCTCCCTTTGCTGCTTGCTGGCGGCCTTGCTAGGGCTAGAAAGTTTTCTCAGCGTTGGGGGAGGGGCTAGCGTT
   CTTGTCCAAAGCACTCATCCTGCTGCAGGGAAGGGAGCTGTACGGAGGCTGGAAGCTGCAGGGTTAGGCCCGAGAGAGCTTTTGAC
   AAGCCTGGCTCTTCCTGCTTCCCACCTTTTTGGCTGAATACCTTTGGGTCCTGGAGGCTGCCAAGGGCGCTTCGCCTTGAGCAGGT
   CCCGGAGAGGCTCAGCCTGCCCCTCCTGGGGCCAGCCTCCTTGCCTCTGCTCTGACCTCAGCAGCTACACCTAACCCCACCGCACC
   CTACCCAGTGTCGATATCCACAACCCAGCCCCCAGGCCTGCACGTTGGAGATTTCTGGATCCTTCCCTGGGAGGGAGAGGTCTCCT
   AACTCGATTGGACAGGAGCCTTCATTCCTTGACTCGTGTCATTTGGGAGCTATTTATTTATTCTTAGTATTTAATTTTTAACATCC
   TCTCAGGGACCAGGGGCCTCCTGCTTTTCAGAGGCCCGAGTGCATTTATCCCAAAACGAGGCATCTTGACATCCCCTATCCCCACC
   CCCTAAATTCCCAAGGCCCTAAGGTCCCTCACCTGGTTGCTCTGGAAGCTCTTGCTGATAGGAATGATAGCAACACTGAAAGAGCG
   TGGGAAGGTGGAGGGTGTCACCAGACCCACACAGAGCAAGGGAGATCAAGGCAGTTCTTGCTGCCCCTTCTCTGGCTGTGCTTTGC
   CTGAGGGAAGAGTTGGCAAGAGGCCAGAATTCTAGTTTGGTTTATGGCGCTGGATTCTGGCTTGAAGAAGCCATATTTGGCATGG
   GTGAAGTGAAAGGGCCAGGAGGTTCTGGAGGCCCCTTCACTTCCAGTCCCATAGCGGGGCTCAGCTATTTTTCTGATCTTATTCAA
   CTTTAGTTGTGCAAAAGAAATTCTAAGTGAATGCGCGTATGACAGGTCAACGTATTAGGAAGGAGCCAGAAAGTATTCATACTGCT
   ACTCCTTATGAGATAGCCAAGAAGCATCATGTCAGTAACTGGGAGTGGAGAGGGAGTTTTGTTTTGAAACTATGCAGGTATTTTTC
   AGCATCCATTTGTACATTAGTATGGTTCTACAGGACCCCAGCTGTGGAAGTAACAAATTTCTTCTCCCTCCAGACTCTTGGATGAC
   TACCTAGATCCCCAGCTTACCGGTTAGTTTCCTCCACAGGCTTCCATGAGCTCAGTGTCCCAAGACAGCAAAAATCTGGTATACCC
   TGTAGAAGCAGGGGGGTAGCAAATTTAGGCTCTCTTCGAAATTACTTGTACAATACGAGTGCCTTCGCAGCTTAGCCCCAAAGTGC
   TACTTATGTTTCCCAAGGTCTTTTCTATTCAAATCATATTTGGTTTCAGGCCCCTTTATGGGCATACGGTAACAGAAACCTCCATC
   ATTCATATGAGACCCTTTTGTCAGTGGTAACATCTTGTACTTGGAAAAAAAATTTTTTTTTTTTTTTTTTTTTTTGAGACAG
   AGTCTCATTCTGTCGCCCAGGCTGGAGTGCAGTGGTGTGATCTTGGCTCACTGCAACCTCCGCCTCTTGGGTTAAAAGAATTCTCC
   TGCCTCAGCCTCCTGAGTAGCTGGGATTATAGGCACACACCACCACACCCAGCTAATCTTTTTGTATTTTTTTTTTAGTAGAGAC
   AGGGTTTCGCCATGTCGGCCAGGCTGGTCTTGAACTCCTGACCTCAGGTGGTCCACCCGCCTCGGCCTCCCAAAGTGCTGGCATTA
   CAGGCGTGAACCACCGTGCCTGGCCGGAAGTCTTTAAAAAATAAAGTGATTCTACTCTTCTAAGCTTACAGAGACCAGACCAGGTG
   AATGTAACTGGGGAAAATCAAGATGGTACCTCTCTGCATTATCCCGCCAGACACTGTATTTTATGCATTCATGTCTAGGATACAGT
   GTGAAATTAAAAAGTTTAGAGGGCAGATGCAATTGTGGCAAGTGACCTGCCAATAAAGCAGGTGCAGCTATAGAAGCTGGCATAG
   GTATATCCTTAATGGTGCTTTCTCCCTGGGCTTGTCTTTTTGTTGTTTTTTCCCCTATATTCAGAGCTCCTTGAGAAGTGATAA
   ACACCTCCAGCTTTCTAACATCCTCCCCACACCATCTCACCATATCCATCTCCCAGCATCCATCTGCATTCAGCTAAGGGCGGGAA
   ACTGACCTAGTGCCTGTGTTGCAGACCCATTTCTGAGGTCTCCACCATCCAAGGAGGCACAGCCGTCATTACTGTCCTCCATGCCTT
   CAGCAGCCCCCCTCACAGCTAAGGTACATACCACCCCTTCTGCCGCGCCTCCACCCCTGGCACCAAGGTCTTCTGCTGCTTATGTC
   TAAAGGGATCACCTATATTTAACTGCCTCAGTGACCTAACCTCTTTCTTCTCATGTGCCAGATGTTAAGATGAAGGAGGAATACAA
   CACATATCTCAAGCCTCAGCCTGTTTAGTTGTTTTCACTGGGGCTCGCTTTTCTGGGACGGTATTTATTATCAGACTGGCAAGCCTA
   ACTCCATAGGTTTACAGGAAGTAGGGATATTTTTATAAAACAATTGTGTCCTCCCCACATTTTGCTATGTTAATATTTGCTTCTAA
   CAATTTGCAGCTGTTTCACTTTTTCCTCATTTGTCTCTAAGTTGAAGGCTTTGTTGGAGGGGACAGAGCACAGGAACAGCCTTGAC
   AGTCTGTAATTATTGTACAGATATTTTAATAGCATATAAATAAGTATATTCCTTTTATTTTGAAACAAAAATGATCAGACACTGCC
   TTTTGTGTGTTTGCTGCCTGTGGCATCCTTTTTAAAAAGACTGTTACATATTAAAATAGTGTACATATATAAATATTACCTCTTT
   TGCTGTACAGTTGTGATAGAGACTGAAGATTTTATTTTTTGTGTGCTTTTTATAAGAAAAAAATTAATACACTAAAGAATCTTGCT
   GATGTGATTGTAATGTACCTATGTAACTTATTTACTTTTGAATGTTCTTCTGTATCTTTAAACCTTTTATTAAATAAGGTTTTAAA
   AATTCAAAAAAAAAAAAAAA

64 AGTGCTCACAAGTTTATATTTTAGGTTTGAATAAAGATTCTTGTGTATTTCTAAATACACAGACAAAACAGTTCCGGAAGTTTA
   CATACATGTCTTAGGACACTTATATTAGGTAGGTAATTTACATTTTAAAAAGTTGGTCTTCGTAAAAGATCTTCCCAAAGAGCTTT
   TACAAACAGCAGGCGGAAGTGTTCTTTTGTTTACAGTGTTCAAAATGCCAATGCTCCCACTAAATAATGGCCTCAACCATCTCTCC
   TCAACCCAAAATATTGTTCTCAATAGCTAGTGTACTCCAAATTTAAGTACCCAATGTCATAAAATTTAGGGCTAGAAAACATCTTT
   TGAAGTGTGCTTATCCCTAACACATTTTAAACTATCTAGAATTCTTTAACTTCAGTTGAAAGCAGAGATACAGCAGAAAAAAAAAA
   AAAACTTTCCATTTTAAGTCCNAAAGTGGACTAAACACCTGTTAGTTCNAAGTGTGGATATTATGGTNCC

65 AGTGACGCGGGCGCTGCAGCCGTCGCTACCGCCGCGTTCTATTCTCCGAAGCCGGCGACCGCCCCACCTCCTCCCTCCCTCCCGCC
   CGCTTCCTCTGCCCACAGCGCCGGCCAGAGCGAGCTAGACAAGGGCACGCGGGGCCTCGCCTAGACCCGAGAAGACTGCGGGCGCG
   CGCAAGCGGCGGCGTGGAAGCTGTGAGCGCCCCCATCCCGGAGGTCTCCGCGGCTCCCGGGTGAATCAGCTCCCGGCCGACTTTA
   GGATTCTTCTGGGTTTTAAATTTTTTCTTTTTAAAAAAACTTGGACGGATAAAAGATGTGCCATGGCAGGATAGCACCAAAGAGCA
   CCTCAGTGTTTGCCGTGGCCTCCGTGGGACATGGAGTGTTCCTTCCGCTAGTGATCCTTTGCACCCTGCTTGGAGACGGACTTGCT
   TCCGTGTGCCCCCTACCACCGGAGCCAGAGAATGGTGGCTACATCTGCCACCCCGGCCCTGCAGAGACCCCTGACAGCAGGCAG
   TGTCATCGAATACCTGTGTGCGAAGGCTACATGTTGAAGGGCGATTACAAATACCTGACGTGTAAGAATGGCGAGTGGAAACCAG
   CCATGGAGATTAGCTGCCGTCTCAACGAGGATAAAGACACCCACACATCACTTGGGTCCCCACGCGTGTCTATAGTGGCTTCTACT
   GCCAGCTCCGTGGCGCTCATTCTCCTCCTCGTGGTGCTGTTTGTGCTGCTGCAGCCAAAGCTGAAGTCTTTCCATCATAGCAGGCG
   TGACCAGGGGTATCTGGGGACCAGGTCTCCATCATGGTGGATGGAGTCCAGGTTGCACTACCATCATACGAGGAGGCTGTATATG
   GCAGTTCTGGTCACTGTGTGCCACCTGCTGACCCCAGAGTACAGATTGTGCTGTCAGAAGATGATTGTGTTCCAGGTCAGTGGGAGGAGCGTG
   CCAAGGGAGCAACAGCTGCCGGACCAAGGGGCCTGCTCCTCTGCAGGTGGAGAAGATGAGGCCCCAGGCCAGTCTGGACTATGTGA
   AGCCTGGGCTCTCGGGCCTCAGAGACTGTGATGGTGCATCAGGCAACACCTCTTCCTGGGTGGCCGGCTCAGGGAACCGCCAAC
   TGGCACACAAAGAAACTGCAGATTCAGAGAACAGTGACATACAAAGCCTTTTATCCCTCACGTCAGAGGAGTACACAGATGATATT
   CCACTGTTGAAAGAAGCATGAGGGCACCGCAGCCTTTCCTCTCTGCGAGGGCTTCTCAGCCCTTCCTCCCTCTCCCTGTGGAT
   TGAGCACCCTGTACTCTCCAGCCACCTTACCTGGATACCTGAGCTGCCACCTGTGTATCTGTGTATCTCTGAGGGCCCTATAGGCC
   CACCTTGCTGGAAACTCAAGGAAGATTCTCGCCATCTGCCTGTTGGACAGCTGGAGGAGCTGGCTCTTTGCCTGGCCCCGCCTTCC
   CATCTGTCAGAGACATATTTGAATGTGCTGGATCAAACCCTCCCTTTTCCTAAGCCTCTGGGTCCCCTCCAGCCAGCTCTTTGGCG
   GCAGCCCCCACCAGCTCCTGTGGGCCTGAGTGCTGCTGTGTTTTACTTGTGCCTTTCCCCCACCCTGTCCAGTTTCCCTGTCATGCA
   GACTTTGCTGTCCACAAGCCTTAGTGGCTGCACTGCTGCCCCCTGCCACACAGGGGGCCGGGCCTGGGTCTGTCCTGTTTCCTT
   TGAGGGTTGCCCCTACTGCCCTTTGCAGGAACAGATCCAGGTGTGAGAGCTCTTGAGTCAAGAGTGGCAGAAGTGGCTCTAATTGG
   GGTGAGAGTGTAGTCCCTGGGCTTGCCCTGGGTTGACCCTGGTGGCATATTTCCTTGGCCGAGGATGGAAGATTTGGAGAATCATG
   TCCATGCTGGCCCAGGACCCAGCCATCTGGCCCAAAGGCACAAGCTCCTGCCCGTGTTGAGTTGAGAGTTTTCAAGAAGCATCCAA
   AAGATCCCAAGGGAGAAGGAAAATGGCTGATAATGATTGTCTTCCTAATATGCAAGTTCTCACTTCCTACTTCCAGCATCGGCC
   TTCCTGGCCTTGTCTTTTTTTGTTTCCCTGGAGTATAATGGGAAGTTGCATGCTGCCTCCTGGGTTTATCCCAGATAGCTCTGG
   CTTTCTTGCTGCCCACAGGGGCCTGGGCAGGAAGGAGACTTGCTGAGATGCCATGGAGTGCCCATCTGGTCACTGGCAGTCTGGG
   CAGGTTGCCCCTTTCTGGGTTTGTGGTGACGGAGGGGAGGCCGAGAGGCACAGACCAAGTCCCCGGGTGGCTGCAGGCAGCTCCAG
   CCCGGTCCTGAGGATCCTCCTCACCATGGTCACGTGCCTTAGTAACTGTGCCCAGGAAGTGGCCTGCTGCTTGCTGTGCTGCTGCT
```

TABLE 1-continued

Sequences Table. First column: SEQ ID No. Second column: corresponding mRNA sequence. For the 3 different groups, see explanation in the text.

TTTCCTACTTCTGCCCTTCCCTGCCACCCCTCGCATGTCACAGCTGACAAGCAATTCCTTGTCTTCCCTGGCCCCCTGGGGGAAGG
GCTGAGAAACAGTCCATGTGCACCCCAACCTTAATGGCCTGAGGTGGGCAGAGGGGTGTGGAGCAGCCTGGAGTACAGGGCCCTGG
GGGAGGAGCCCACTGATGAGGGGCGCTCTCCCATAGCCATGTGTTGAATGCTAACTAGGCTGGGGTGGACGAACTCTGCCAACTGC
TGTCATCTTAGAAGATAGATGCAGCAGTAAGGAATGTTTGTTTTGCTTTTTTCTGAAATTTTCTGAAGCACTGTGGCTGGGAAACT
TCGAAGCGGACCCTGTGCTGCATGTCTGCTCCTCCCCTGAGCCTGTCTGCTTGGGGGTGGTAAAAATAAAAATCCCAGTTTATTTT
CAGTACCTTACCTAACAGGGTTGGCTCCAGGCGTGGGTGGCCTAGAAGATGAGGGGAGTGGTCTTCTCCCAGCCTTTTACCCTCTT
GCCTCCTGCCTCCGCGCTTACACACGCACTTTACCACCCGGTCATTCCCTGGCCTCTTGCTGCCACTTGTAGTCTTCCTTCCTTCC
TCTCAGGGTAAGGGCAGTGCCTGCTGTGCCTGTTGGCCACTCCCACACTTCCCCTCCCCCAGGAGCCCTCATCTGCTGTGCTGAGT
CCAGGAAAGCATAGTTAGGTAGGGAGCTGGTTGGAGAAGGTGCTAGAACTAGAAGGCAGATGAGACTAGCATGGGCCCACCTGGAG
GGCTGTCCCTAATGGCCCCAGTCGCCTTACCTCACCCACAGCAGTGCCCTTGTCTTCCTCCAAAACAGAAAGCAGTGACAAAAGGG
GGAGGGGTGGTAATCTGAAGTCTCACTGCTGAGCCTTCAGCTTTTATTTTTCACTGTTTCAAAACCCGCATTCTATTCTAGAATGG
TTTTTAAAATGGAAGATCTTACCTTTTTCTATCTTGTTACTCTGGGGTTTTGTCCCCTAAGAGATTGCACTTTTTGTTTGGGGTT
TATTCAGCTGCATAGATGACCAGCTTGATCCCTGGTGAAATGAAAAGCCTTCCTTCTCCTGAAGCCTCTTTCCGCCCTGCCCTCCA
CTAACAACACTGAGGAGCACAAGCCCAGGCTTGCCCACCTGGTAGGAAAGGAAGAAATTAGAACAATGGGAGCCTTGGCTCCCCTC
TCGTCCTCCCCTCCTTCTTGTCACTGGCTTTGATGAGGCCCACTTCCCAGAGGCTCCTGGGCCTGTGAGTGCAGGAGCTCATTC
TCCCCTCACTGCTGAAGTCTGTGACAGCTTCTTCCTCCAGTTATGTCTTTCTTCCAAAGCAATTTCTTAACCATCAGCCATGTGCT
GCTATTTCTAGGGCTTCTGGGCTTTGTCCCTTACTGAGAGATTAGGGACTCCACAGCTGCCTTGAGGTAGGGCCTGGCTGAGAGAC
AAGGGTAGCAGCAGGTGGCAGGCTGTTAAAAGACAGGCTGCCTGAGGAGCCTGGAGCAGGTGGAAACAGGTGGAAGAAACCGGCCA
CAGCCCTGCTTTACCGGGCTCACCTCTAGGGCATTCAGCAAGAGGCTGATGCAGGAGAATGGCCAGCACCAAAGGACATTTAAAA
GAGTTTTTGGGTTTTTTGTTTGTTTGTTGGTGTTTGTTTTTTTTTTTTTTTTGGCACACTTGAGCTGACTCAGTGCAGGT
TTAATATCCTGGTGACTTGCAGTCACATTCTAATGACTTTCAAGGGCCAGAATATGGTGAAAATCACTTAAAATATCCGTCCCTTC
CATGCCTTAGTTTAGCAGGTAGGCTCTATCTTTTGCCATTTCTGTATTTTATGTGCTGTGTTCCCGTTTCACTGGGTATGAACTGT
GAAATGGACTGAATCCTGGCCACTTTATGAGTTTGTTTGGTTTTATAAGGCATTTCAATGTACATTCTATAAATACAAGCACTCCA
TTTGCAAACAGATCTTAAGCTAATATTTTCTTTCCCATTCATCTTGCCCTCCCCCTCCTCCCGCCAGCTTTAAAGTTCAGTGGAGA
AGCCAGATGGCAATTCAGACAAAGGTATACTCTTCCTGCTTCATGGGTGGTGGCACGGGAATAGATAGCCCTTAGCCCTTTCCCTC
CCAGTCCCAGCTGAGCCCTCAGACCACTTGCTTCCCACATAACAATGTCGCCTCCATTTCCGAGGAACATCCTTGCGTAGAGAATG
AAATATGCTGCAATCATTTCTGCATCCTTACTCCTCACCCCCAAAGAAAAAAAAAAGGCCTAGCAGGGAAGCAGCATGCAGGCTTC
ACAGCTTAATGCCAAGGACAGCGAGTGAGGCTGGGAGCTTCTCTTGGGCCTGCTGGGTCTGTCAGCTCTCGGAATAGGGACAGTCC
TTACTGGTGCCCCAAGGTGGGACTTGGAGAATATTTTGCTTGGCATATGTTTGGTCTGAATGGTGTAGTTGCTGGTTCCCTAGAGA
GGAAAAGGTGGCAGGCCCAGCTTTGCTGGGAAATGGCTCTTAATTTCCAGTTGAAAACCCTAGTAGAATTGTGAATGAAAACCTCAA
GGTTGAGCCCCTCTGCCAAGCAGCAGAGCTAGTAGAAGGGGATGCAGGGGCAAAGCACTCAGTTGCCAAGCAAGGAGGAGAGATGT
ACGTGGGCTGTGTGGCAGTCCCCACACCCTGCCCTGGCTTCTTCAGGTTATCGCACCACTATGGAATCCTTTGCAGAATGGTACTC
ATATAATGGTTTAAAACAACACATTCATAATTGACTCTGTGCAGGATGTCACTCAATCAGTTTGGGTTTGCTTTATTTTATTTTAT
ATATATATTTTTTGGTATCCTGTACATTGCAGTGGGTGTGAAGATAGTATTTTAATATTTGTACAAAGTTTAATTTAATTTTAATT
GTTCTATGTATATAACTGCATTTCTAAATAATTAAAAAAAAGTTCTTATGAAGGCAAAAAAAAAAAAAAAA

66 GGTCCGAGTTCGGAATTTCGGTTCAAGGCCCAGTTCCTCGGATTGTTCCTGCGCAACTTCAGTTTCCCTTCCAGGCACGGGCAATG
AGTGTTTGGCCGCGACGAGTTGGAAAGCCCGGATGCGTCCTTCGGTTGGGCGGGGTGTCTCAGTGACGTCACTGGGGGTATAAAAG
GGCCTGGGTGGCGGGCGCCTGGGCAGAGCGTCCTAGCAGTGTCACTGCGTGGGTTGGTTTGTGTAGAGAGGCGTGAGCGAGCCCGT
TGTCCGGAGTGCACCTGCTGCCTGTTCTGTCCCTCCCGGGAGCCCCGCCGCTGTCGCCGTCGAGTCGCCATGGAAGTGCAGAAAG
AGGCACAGCGCATCATGACCCTGTCGGTGTGGAAGATGTATCACTCCCGCATGCAGCGCGGTGGCCTGCGGCTGCACCGGAGTCTG
CAGCTGTCGCTGGTCATGCGCAGCGCCCGGGAGCTCTACCTCTCGGCCAAGGTGGAGGCCCTCGAGCCCGAGGTGTCGTTGCCGGC
CGCCTCCCCTCTGACCCTCGCCTGCACCCGCCCCGAGAAGCCGAGTCCACGGCCGAGACAGCGACCCCCGACGGTGAGCACCCGT
TTCCGGAGCCAATGGACACGCAGGAGGCGCCGACAGCCGAGGAGACCTCCGCCTGCTGTGCCCCGCGCCCCGCCAAAGTCAGCCGC
AAACGACGCAGCAGCAGCCTGAGCGACGGCGGGGACGCTGGACTGGTCCCGAGCAAGAAAGCCCGTCTGGAAGAAAAGGAAGAAGA
GGAGGGAGCGTCATCCGAAGTCGCCGATCGCCTGCAGCCCCCTCCGGCGCAAGCGGAGGGCGCCTTTCCAACCTGGCCCGCGTCC
TGCAGAGGCGCTTCTCCGGCTCCTGAACTGCAGCCCCGCGGCCCTCCGACGGCGCCGCCGCCGCTGCGAGGCAAAGCCCGCTTGC
CGCCCGGCGGACAGCATGCCTCAACGTGCTCGTCGGGCCGTGGTGGCCTTCTGAGGACCCCGAGCGGCGCTGCCGGAGCCCAGAGC
GCGCGTCGAACCGTCGGCCCGAGGGCGCAGACCTGAGGCGAGGCCACCCCCTCCATCCTGGGGGAAGCGCCCGCGAAAACCGTGG
AGAGAAGCCGCCGCCGGGCTGCTGAGGAGGCCCGGAGAGGGACTCTGTCCCCGGGGAGCCATCGCCTTCAGTGTGCAGGGACGGCA
CCGAGGAGTCTGAGCCGGGGGCGCGGGCGCCTTCCGCAGAGACCTGCGCCCACAGGTGCTGTCTTAGTGGACTGGGACGTGAACCT
TTCGCTCTCCTTCTGGACTGGGAGAAGGGAGGCTTGGGTGTTGTGTTTTTTGTTTGTTTGTTTGTTTGTTTTTAAAGATCTCCTC
AGGGTCGGACTTCATTTTGTACTGTGGGCTGTGCTGGCCCTTTCAAGGTTTTTCAAGAGTTGGTTTTGCGTTTCCAACCTCGGAGA
ATTCCAGGCACTCCCCTTCCCCCTCCGCTGACATACTTGTATAAGCGGTCATCGTTGCGTCATGGGGCAGGCGTGGGGAGCTTCCT
GTCGCCTTGCGTGGGTGTGGGGCCTGGGAGGAGGTCCTGGGGCGTGCACCCGCCCTGGGCAGTGGGGAGGAGAGTGGCCTGAGTTA
CTTCACCCCCGCGTGCTGCTGGTTAATGTCCCGCGTCTCTGCACCTTCGGGTGGGAGCGGGGACTGATCTACTTTCACATTCTCAA
GTTTTTCTCATCTGCATTAGAGGTGCCCAGTAGGTTCCCAGGTTCCAGCGTGCCCCTCCCTCAGACACACGGACACAATCAGCCGA
GAAGTTCCTGGTCTGAATCACGAGAATGTGGAGGGGTGGGGGGTGTCAGTGGAAAGGCATAAGGCTGAGCTGAGACCAGTTGCTGG
TGAAACTGGGCCAATCTGGGAGGGGAACATCCTTGCCAGGGAGTTTCTGAGGGTCTGCTTTGTTTACCTTTCGTGCGGTGGATTC
TTTTTAACTCCGTCTACCTGGCGTTTTGTTAGAAATGTCAGATAGGAAAATAAAAACCATTTGAGTAAAAAAAAAAAAAAAAAAAA
AAAAAAAAAAAAAAAAAAAAAAA

67 CTCGGGGAGTGGTTGTCTCCCTTTCCTGGAGTCATTTGTGGGAGTTAGGGTCTTATCCTGATCTTTCCTCGTCCCCGCTCCCCCG
TCCTCCGAGGTGGCAGCTGCGTAGAAGTCTGGAACGTTTTTCTTAGAGTTCCAGAATTGTGACTGAAGTGTACCCAGAGACACAA
AGAAATACAGAAGTCCAGAATGATCAAATGAGATCACTACCCAATGAAATGATAGGCCGAGGAGCCAGAAATTGTCCTACTACCTG
CTTTCCAGGTCCAGATTCCACGAGAGCCTTCTGGGCTCCCACCAGAGACCCTCAGTGAAGACTCTGTTGAAGACTTTAAGACCATG
CTAGAAAGCCTCCCGGCAGAGGTTCAGGAAGTTCTGCTATGAGGATGCAGCTGGCCCCAGGAGGATGTCCTCAGGCATCTCTAGGACC
TTGCTGGACGGTGGTGGCTGAGACCTGATATCCACACAAAGGAGCAGACTGTGGAAATGCTGGTGCAGGAGCAATTCCAGGCTGTC
CTGCCCGAAGGAGCTCAGAGCTCAAGCACAGAGATGTCATCCTGGAATCAGAATCACTGGCTAAGTCTTGCTGCTTGCTTCTTGCT
CAGCCTGCATATGAGAAGTCAACCAAGCATTCTCTTGGATGCAAGATCCAACTGCACCCATGGGAAATCTGAACTTCCACTTTCTT
TGAGCTTGTCTTTGGTTGTAATAAGAAGATCCATCAAAACCCATGTCTGAATCTCTCTTTGGCTGAGGCAGCTTTATTTCCTACAGAG
TTTCTCTGTCCTCTTGTTAGGACAATCAGCCTGCTGCTTTGGGCTTTTCCAAGAGCCTATTTTTCATCTGCTGGATGCCTCTTTTT
TTTTTTTTTTTTGCACTTTGTGACATGCTTTAATATATATATTTTTTATGTATCCAAAGAGGTAATCAACTTTAACTTTCAGAATT
CATGAATCTTGGTTTGGTGGCATGAATGAAAGGTTATGTAACCCCACCAGTAACTCATTTGGGGTGCCCTTGAAATATTTAAAGTTT
GGTCCTCAATCAAAAAAAAAAAAAAAAAAAAAAAAAAAAAA

TABLE 1-continued

Sequences Table. First column: SEQ ID No. Second column: corresponding mRNA sequence. For the 3 different groups, see explanation in the text.

| | |
|---|---|
| 68 | ATGAGGAGATCTGTCTACTGCAAGGTGGTTCTAGCCACTTCGCTGATGTGGGTTCTTGTTGATGTCTTCTTACTGCTGTACTTCAG
TGAATGTAACAAATGTGATGACAAGAAGGAGAGATCTCTGCTGCCTGCATTGAGGGCTGTTATTTCAAGAAACCAAGAAGGGCCAG
GAGAAATGGGAAAAGCTGTGTTGATTCCTAAAGATGACCAGGAGAAAATGAAAGAGCTGTTTAAAATCAATCAGTTTAACCTTATG
GCCAGTGATTTGATTGCCCTTAATAGAAGTCTGCCAGATGTAAGATTAGAAGGATGTAAGACAAAAGTCTACCCTGATGAACTTCC
AAACACAAGTGTAGTCATTGTGTTTCATAATGAAGCTTGGAGCACTCTTCCTTAGAACTGTTTACAGTGTGATAAATCGTTCCCCAC
ACTATCTACTCTCAGAGGTCATCTTGGTAGATGATGCCAGTGAAAGAGATTTTCTCAAGTTGACATTAGAGAATTACGTGAAAAAT
TTAGAAGTGCCAGTAAAAATTATTAGGATGGAAGAACGCTCTGGGTTAATACGTGCCCGTCTTCGAGGAGCAGCTGCTTCAAAAGG
GCAGGTCATAACTTTTCTTGATGCACACTGTGAATGCACGTTAGGATGGCTGGAGCCTTTGCTGGCAAGAATAAAGGAAGACAGGA
AAACGGTTGTCTGCCCTATCATTGATGTGATTAGTGATGATACTTTTGAATATATGGCTGGGTCAGACATGACTTATGGGGGTTTT
AACTGGAAACTGAATTTCCGCTGGTATCCTGTTCCCAAAGAGAAATGGACAGGAGGAAAGGAGACAGAACATTACCTGTCAGGAC
CCCTACTATGGCTGGTGGCCTATTTTCTATTGACAGAAACTACTTTGAAGAGATAGGAACTTACGATGCAGGAATGGATATCTGGG
GTGGAGAGAATCTTGAAATGTCTTTTAGGATTTGGCAATGTGGAGGCTCCTTGGAGATTGTTACTTGCTCCCATGTTGGTCATGTT
TTTCGGAAGGCAACTCCATACACTTTTCCTGGTGGCACTGGTCATGTCATCAACAAGAACAACAGGAGACTGGCAGAAGTTTGGAT
GGATGAATTTAAAGATTTCTTCTACATCATATCCCCAGGTGTTGTCAAAGTGGATTATGGAGATGTGTCAGTCAGAAAAACACTAA
GAGAAATCTGAAGTGTAAGCCCTTTTCTTGGTACCTAGAAAACATCTATCCGGACTCCCAGATCCCAAGACGTTATTACTCACTT
GGTGAGATAAGAAATGTTGAAACCAATCAGTGTTTAGACAACATGGGCCGCAAGGAAAATGAAAAGTGGGTATATTCAACTGTCA
TGGTATGGGAGGAAATCAGGTATTTTCTTACACTGCTGACAAAGAAATCCGAACCAGACTTGTGCTTGGATGTTTCTAGACTCA
ATGGACCTGTAATCATGTTAAAATGCCACCATATGAGAGGAAATCAGTTATGGGAATATGATGCTGAGAGATCACGTTGCGACAT
GTTAACAGTAACCAATGTCTCGATGAACCTTCTGAAGAAGACAAAATGGTGCCTACAATGCAGGACTGTAGTGGAAGCAGATCCCA
ACAGTGGCTGCTAAGGAACATGACCTTGGGCACATGAAGATCATGTCCTCCAAGCCATGAAAGTGTCTACGCTTTTGTTTTCCAT
TATTTCAATTGGGGGAAAATATTAACTTTGCTGAATTGAAAGTTTTAAAAATCCTTTTAGTATTCTAAAACACAATTGTTTCTAAT
TCGTTTCTAGAAATGTTTGCTTATTTCCCTACTAAAATTTGTATCTGATCAAAGCACATAAGAATATAAATAATAGCAAACTACTA
TTAAACAACAGAACAACTGTAAACAAATTGTGTTTGCTTTAAGAAAAATCTTTATTGCACTCATGTCATAGGGTTAATTGGAGG
TTATTTTATTTTTGGTTGTCATGGTGATTGAAAGAGATAATGTAAATGCCTTATAAAATCTTCATTATGAAATATTATCAGTTGCT
TTATAAACTCACTCTTTTTATGGATCCTTCATGGAAACATGTTTGATTTCTGTGTCTACAACAGGGCCACATATTAAATTACTTCT
GAATGGTGAATTCATCTTACAAAATGTTCCAAGTTTTGGACAAGGAAAAACATTACATTGGATATTGAATTCATGGAGCCTTTACA
GAAGCATCACATTTAAACCAATGTGAATTCAAAAAAGAGAAGGAAACTTTTTAAATTCAATTTAGAGTACATAAAAAAAGAAATCC
GCGAAGCATTGAGGGGAACAAGATGAGTCTAATCCGCAGCACTTCGATCACTGTGAGAGAACTCAAAGTGGGTTGCAATCATTCCT
AACACAGGCTGAAACTAAACAATCTTGCTCCCAGAGTTTATGTTGGATACTCAATTCTTAACCAAAATCTTGGTCTCCACAAACTC
TACCATCCCTTTTCTCTTCACTCTATAGACAGTGGCATGCCATTGATGCTGTACAGAATTGCAGGTGAAAGGGAGAATTTTAGACT
TAATTTTTAACTCTATTGCACTTAAAGATTTTAGTTAGGTTACCACTGTCATTTTCATTTTCTATGTTAAAGAATACCTTTCAGTG
CTGTGCTCCAGTATCTAAAAATTTTATCACCAGGGGAATAAACTCAATACACATTCATTAAACTTTTGTTGTAATTAAACTGCTAT
ATATTGTTTGCCATATATTATGGCCCAAGGAATATAGTTATAATCAGGCTACATTCACATTTTCTTTTCTCATCTTAAAACCCTTT
ATGTTCAAAATACATTAGCAGAGGCCATGAAAGTGAAAAAAATCAGATTTTTGCTAGTAAGTTTTTATATTTGACATCATTTTAA
ATGCTCAAAGAGTTGCCCTATATATGCATGTTATCCATTATAAATGCACTCAGCAGCTAAGAGAAATTTGAGAGGAAAAGTGGAAG
AAGTGTTTTCTGGAGCAGAAGATTCCACTTCTTTGGTCCTCATCTTTACTTAAAAAGCTCTTATAGAAAGGATTAATCATTTTGAC
TGCATACAAACTATGTCTCTGACATGCACATACACTGCTTTATAATGAAATGAGGACACTTTCTGATGGTCAGTAAAATCTTAAA
TGATTTTTGCCACTGGTATTCCTTCCTCTTTTGACTTTTTATTGGTACAACTGTAGGGAAGAATCTACAACCTGGAGCATTTCAGG
TTTGCTCTTTACATATAGACACCCCTCACCATGAGCTCTCTGTGAATCCGTGAATTTCCTAAAATTGTAAGCAAAATGTTGAATAT
CAGGGCATTTTTTTTCTGAGGTGGGAGTATGTCACTCACAGCAAACTTGGAAAGAAGGCTATGACTCCCAAGAGGCAGTGAACCA
TTGCCTTAAATTAATAGCAGCCTCTCAAGTCCATTGAGGCCTCATGTAAAATTCCCATTTTTCATCTTTACACTCCTTTTCTCCCC
TCATTTCCTCTTCTCCTTACTAAGGTAAAAAGACCCTGCACAGCATTATTACTTAAGTTGAAAAAGCTTCAACTCTCAAGGACTCA
TGTATACCATATGTTCCACTTATTGCTTTGTTAGTCAAAATGCATGTTATGTAGAAAATGGTCAATGGCAAATTTTTATAAATACA
GCTACCCCATCAAAGCTGAACTTGAAACGTTTTAGCAGAATTTTAAATATGTGAAAGTTCATTGTGGTCATGGTGAGAAAACTAAA
ACTACATGAGTTTCATGTTAGAAAAGAATTTTTAAACAATCTTCAGATGGCTTGAACACGTGCCATTATAGTATCTAACAAAAGT
GGCATAAAATATTACAAAACATCCAACACTAGAAAGCAATGACTAACATTTAATTTGTTTACAAAAATGTTTATTGTCTTCAGTAC
AAAAAGTTAAAACCATGATTGGATTCATAATGCACTTGTCTTATCCCTTATTTATGGAGCTAGACTGACATATTTCAAACCAATCT
CTTCTGTGGTCTTCTCCATCTCAGTTAATGCAACTTCAACCTTCCAGATGCTCAGGTCAAAACTGAAAGTTGCTTTTGACTCCTC
TATTTCTGTTTCAACTCTCGTCTAATCCAACAGCAAATCCCCTTGATGCTACCTTTGAAATATAACTAGAAAAGAATGACTTGCCA
CCATATCCACTAGGTGTCACTACCTCTAACCTTTTTAATCGCAATATGCTTATTATTTAGTTCCCTAATTTCCCAGTCCTTGTCTT
GAACAATCTTTTCTCAGTACAACAGCCATAGTGATTCTGTTAACCATGAATTTGATTGTGTCACTTCCCTGCTCACAATCTTCCAA
TGACTTCTCCCTCCGGTGGCCTTCAAGGTCCTTTATGAGTGTTACCCCTCTACACGTCCACACCACTCACCACATACATACACA
TGCACACACACACATGCAATTCTACCTTTTTCTAACACCATCTCTTATCTCTCATTATTCTGCCTCTTACTTACCCTATTATGG
CTCCCAAGAAAGTTCCTGCTTTAGTGTTTTGTTCCCTCTGCCCCAGGAGAGTCCCCTTAGTGATCTCAGTTCAAATATTATCTTAT
CAGTAAGACAAACCCTTCTCCCATCTGCCTTCCCTATCCCCTGTACCTGACAATCTATGAGTTTGCTTCTTTATTTCTGTCTATAC
TTCCCCCTCCCCAGCCCCAAACATGCCCATCACATGCCCTAGAAGGTAAGTCCCATGAAGGCAGGGCTTTGTCAGTTTTGTTCAT
TTGGTATTTCTGGCATATATATTCTCTAAATATTTCTTGAATTAATGAACTGAAAAATGTGTTAAAGTTGCTAAGTGTAACTGT
ATCATACTTTTTTTGTATTTTAAATTTTAAAATAAAGGCTAATATATTTAGACAGGATTTCCAAAAACTTTGTCTTCAAATTTTAA
TTTTCTTCCTAATATTCTTCACATTAAACTATGGACTCTAATTTTCTGGATAAAATATCCTGCCTTATGGAAATGAAATATGAAAT
TTTATTAAAATGCTGCTATATT |
| 69 | GTCTCTGTGGTTATAAAGTTGGGGGTGGAGTGGCCGGGAGATGATGGCTGATGAAGAGGAAGAAGTCAAGCCGATCTTGCAGAAAT
TGCAGGAACTCGTGGATCAGCTCTACTCATTTCGAGACTGCTATTTCGAGACACATAGTTGTGAGGATGCTGGGAGGAAGCAACAG
GATGTGCGGAAGGAGATGGAGAAAACCCTACAGCAGATGGAAGAAGTAGTGGGTTCTGTCCAGGGCAAGGCACAAGTTCTAATGCT
AACTGGGAAAGCACTAAATGTGACTCCTGACTATAGCCCTAAGGCTGAGGAGCTTCGTGTCAAAGGCTGTGAAGCTGGAGCCCGAGC
TGGTGGAAGCCTGGAACCAGCTGGGTGAGGTGTACTGGAAAAAAGGGGATGTTGCAGCTGCCCACACCTGCTTCTCAGGAGCCCTC
ACCCATTGCAGGAACAAAGTCTCCTTGCAAAACCTGTCAATGGTGCTTCGTCAGCTGCGGACTGACACTGAAGATGAACATTCTCA
CCATGTCATGGACAGTGTCCGACAGGCTAAGTTGGCTGTTCAGATGGATGTCCATGATGGCCGCTCCTGGTATATTCTTGGGAATT
CATATCTTTCCCTTTACTTCTCTACTGGCCAGAACCCTAAGATCTCCCAGCCAAGCCCTCAGTGCCTATGCCCAAGCAGAGAAAGTT
GACAGAAAAGCTTCTAGCAATCCTGACCTTCATCTGAACAGGGCGACGTTGCATAAAATATGAAGAGAGTTATGGGGAGGCCCTGGA
GGGCTTCTCTCGGGCTGCAGCCCTGGACCCTGCCTGGCCAGGACCCCGAACGAGAGCAACAACTTCTGGAATTCCTGGATAGAT
TAACCAGCCTCCTTGAGAGTAAGGGAAAGGTGAAGACCAAAAAGCTGCAGAACATGCTGGGAAGCTTGCGCCCAGCCATCTAGGC
CCTTGCAGTGATGGGCACTATCAGTCAGCCTCTGGGCAGAAAGTGACCCTGGAGCTCAAGCCACTGAGTACGCTTCAGCCTGGGT
GAACAGCGGTGCCGTCATCCTGGGAAAGGTGGTATTTAGCCTCACCACAGAGGAGAAAGTCCCCTTTACATTTGGCCTGGTAGATT
CAGATGGACCTTGCTATGCAGTGATGGTGTACAATATAGTGCAGAGCTGGGGAGTGCTCATTGGGAGACTCTGTAGCCATTCCTGAG
CCCAACCTGCGGCTTCACCGAATTCAGCACAAAGGAAAGGACTATTCCTTTTCCAGTGTTCGAGTGGAGACGCCCCTCCTGCTAGT |

TABLE 1-continued

Sequences Table. First column: SEQ ID No. Second column: corresponding mRNA sequence. For the 3 different groups, see explanation in the text.

GGTGAATGGGAAGCCTCAGGGATCCAGCAGCCAGGCTGTTGCCACAGTGGCATCGCGACCACAGTGTGAATGACCTTTGACTTGCA
TGCTCAACAGGGAGTGGAGGAGAGGAGACAAGGCTCTGGACAGCCGGTCCAGCCACATCCAGTGATTCAGCAGGGATGGGAGGAAT
GTTTTAAATGAAGACTTTCTCTTTCCCTGCCTGTATTACACTTCGTATCTCTTCTCTCTCCTCTGTCCTCATCATGTTCCAGCTCT
CTACAGGGCCACATACTCTTCTGGCATATCTCTCCTGTCTCTTCCACTGCTCTATGTTTAAGCAAAGAGCATGGAATTGGTAG
AAGTCTTGGGATCTTGCCATGGGACAGAGTCCCCAAGGTTCCTGTTGTTGCCTCCTTCCTAAGCCTCATATGTATATATCAGTTCA
GTATTTATTGCTAAAGGAGGGGGCTTAATTTTGTAATGGCTTTTACTTTTAGCAATTTTTATTTTTATTTTTGAACTTTAGGTCCT
TCCTCTTCTTTGGGGCTGGAACAGAATTAAATTTGTTTG

70 CGTGGACTGAAAGTTGCACGGCGGCGTGTGCGTTTCCTAGTTGTCTGGTGCTGCTATATAGGGGACGTGGGGTCCCCACAGACCTG
CAGGTTCCGGCCCCTCTTTTCTCAACCCAGAGCAAATTGAAACGTCCGGGTAACACACCGCTGTGCCACGGTTTTGGCGAGGGCTG
ACAATTGTGAGCTGTAGAAGTACCAGCCTAACAACTGTTCAAGTGACTCCTGACCTAGATGGGTGGTTTCATGCACCTCCAGTACA
ACTGTGGCTCCTAGCAGCTGTGGCACAGGATTTCCAAAGACTCATGTTACGTGAGGAAGCCACCAAGAAGAGCAAAGAAAAGGAGC
CAGGGATGGCTCTTCCTCAGGGACGCTTGACTTTCAGGGATGTGGCTATAGAGTTCTCTTTGGAGGAGTGGAAATGCCTGAACCCT
GCACAGAGGGCTTTATACAGGGCTGTGATGTTGGAGAACTACAGGAACCTGGAGTTTGTGGATAGCTCTTTAAAATCCATGATGGA
GTTCTCATCAACCAGGCACAGTATTACAGGAGAAGTGATCCACACAGGGACGTTGCAAAGACATAAAAGTCATCACATTGGAGATT
TTTGCTTCCCAGAAATGAAGAAAGATATTCATCACTTTGAGTTTCAGTGGCAAGAAGTTGAAAGAAATGGCCATGAAGCACCCATG
ACAAAAATCAAAAAGTTGACTGGTAGTACAGACCGAAGTGATCACAGGCATGCTGGAAACAAGCCTATTAAAGATCAGCTTGGATT
AAGCTTTCATTCGCATCTGCCTGAACTCCACATGTTTCAGACTAAAAGGGAAAATTAGTAACCAATTGGACAAGTCTATCGGTGCTT
CCTCAGCTTCAGAATCCCAAAGAATTTCTTGTAGGCTCAAAACTCATATTTCTAATAAGTATGGGAAGAATTTCCTCCATTCTTCA
TTCACACAAATACAGGAAATATGCATGAGAGAAAAACCTTGCCAAAGTAATGAGTGTGGCAAAGCCTTTAATTATAGCTCACTCTT
AAGGAGACACCACATAACCCATTCAAGAGAGAGAATATAAATGTGATGTATGTGGCAAGATCTTTAATCAGAAGCAATACATTG
TATATCATCATAGATGTCACACTGGTGAGAAAACTTACAAGTGTAATGAGTGTGGGAAGACCTTCACTCAGATGTCATCCCTTGTA
TGCCATCGTAGACTTCATACTGGAGAGAAACCTTACAAGTGTAATGAGTGTGGCAAGACCTTCAGTGAGAGTCATCCCTTAGATG
CCATCGTAGACTTCATACTGGAGAGAAACCTTACAAGTGTAATGAGTGTGGCAAGACTTTTGGTCGAAATTCAGCCCTTGTAATTC
ATAAGGCAATTCATACTGGAGAGAAACCTTACAAGTGTAATGAGTGTGGCAAGACCTTCAGTCAGAAATCATCCCTTCAATGCCAT
CATATACTTCACACTGGAGAGAAACCTTACAAATGTGAAGAATGTGACAATGTTTACATTCGCAGATCACACCTTGAAAGACATAG
GAAGATTCATACTGGAGAGGGATCATACAAATGTAAGGTTTGTGACAAGGTTTTCCGGAGTGATTCATACCTTGCAGAACATCAGA
GAGTTCATACTGGAGAGAAACCATACAAGTGTAATAAATGTGGCAGGAGTTTCAGTCGGAAGTCATCCCTTCAATACCATCATACA
CTTCACACTGGAGAGAAACCTTACACATGTAATGAATGTGGCAAGGTTTTTAGTCGAAGAGAAAACCTTGCACGTCATCATAGACT
TCATGCTGGAGAGAAACCTTACAAATGTGAAGAATGTGACAAAGTTTTCAGTCGCAGATCACACCTTGAAAGACATAGGAGAATTC
ATACTGGGGAAAAACCATACAAATGTAAGGTTTGTGACAAGGCTTTCCGGAGTGATTCATGCCTTGCAAACCATACGAGAGTTCAT
ACTGGAGAGAAACCTTACAAGTGTAATAAATGTGCGAAGGTTTTTAATCAAAAAGGAATCCTTGCACAACATCAGAGAGTTCATAC
TGGAGAGAAACCTTACAAGTGTAATGAATGTGGCAAGGTTTTTAATCAAAAAGCAAGCCTTGCAAAACATCAGAGAGTTCATACTG
CAGAGAAACCTTACAAGTGTAATGAGTGTGGCAAAGCCTTTACTGGACAGTCAACACTTATTCACCATCAAGCAATCCATGGGTGT
AGGGAAACTTTACAAATGTAATGATTGTCACAAAGTCTTCAGTAATGCTACAACCATTGCAAATCATTACAGAATCCATATTGAAG
AGAGATCTACAAGTGTAATAAATGTGGCAAATTTTTCAGACGTCATTCATAACTTGTAGTTCATCAGTGAACTCATACTGGAGAGA
AACCTTACAAATATCATGACTGTGACAAGGTCTTCAGTCAAGCTTCATCCTATGCAAAACATAGAATTCATACAGGAGAGAAACCT
CACAAGTGTGATGATTGTGGCAAAGCCTTTACTTCATGTTCACACCTCATTAGACATCAGAGAATTCATACTGGACAGATGCCTTA
CAAATGTAAGGGTGGCAAGGTCTTCACTCTGTGGTCATTCCATGCAGAACATCAGAAAATTCATTTTTGAGATAATTGTTCCAAAT
AAAATGAATATAAAAAATCATAAAACTTTAAAAAAAAAA

71 TTTTTTTTAAGTAGACATGACAGAATTTTAAATTTATAAATCNNCCCNATGTATCGCATACATTCACTTTACATATTCAAAAAACG
CTAAACTTAAGAAACTGAAAAGTTGAAAAATAAGAGGTAGTAGTACCCACTGAGTGACGTTCTGGCATTCTATTAAATATTCTACA
TTAGAAGATTATAGGGAAAAGGGAGCTGAATTCTAAGAACAAATGTAGAGAAGGCAACCCTATGGTCTTGGGAAAGACAATAA
TGGAAGGAAAAATATATTCAAATGTATTGTACAAATTGTTAGACATGCATCACTTACAATAAACAGAAGGGTAATTATTTTGTGG
GGTAGGCATAAAGGGGAGGAAGGGGGATTGGGGCCCGGGCACCTTTGGCCTCNACGGTCTTGGTAATTCTTCC

72 CCTCTGGGGCGTACCGGCTTGGCGCGGCGGCAGCGGCAGCGGCGGCTGGGAGAGCGGTCGGCGGGGTTTCTTCGTTGCATTGCCTG
AGAGGAGCGGAGTCTGCCAGGTGGTGTCCATCATGTTCTCTTTCAACATGTTCGACCACCCTATTCCCAGGGTCTTCCAAAACCGC
TTCTCCACACAGTACCGCTGCTTCTCTGTGTCCATGCTAGCAGGGCCTAATGACAGGTCAGATGTGGAGAAAGGAGGGAAGATAAT
TATGCCACCCTCGGCCCTGGACCAACTCAGCCGACTTAACATTACCTATCCCATGCTGTTCAAACTGACCAATAAGAATTCGGACC
GCATGACGCATTGTGGCGTGCTGGAGTTTGTGGCTGATGAGGGCATCTGCTACCTCCCACACTGGATGATGCAGAACTTACTCTTG
GAAGAAGGCGGCCTGGTCCAGGTGGAGAGCGTCAACCTTCAAGTGGCCACCTACTCCAAATTCCAACCTCAGAGCCCTGACTTCCT
GGACATCACCAACCCCAAAGCCGTATTAGAAAACGCACTTAGGAACTTTGCCTGTCTGACCACCGGGGATGGATTGCCATCAACT
ATAATGAAAAGATCTACGAACTGCGTGTGATGGAGACCAAACCCGACCAAGGCAGTGTCCATCATTGAGTGTGACATGAACGTGGAC
TTTGATGCTCCCCTGGGCTACAAAGAACCCGAAAGACAAGTCCAGCATGAGGAGTCGACAGAAGGTGAAGCCGACCACAGTGGCTA
TGCTGGAGAGCTGGGCTTCCGCGCTTTCTCTGGATCTGGCAATAGACTGGATGGAAAGAAGAAAGGGGTAGAGCCCAGCCCCTCCC
CAATCAAGCCTGGAGATATTAAAAGAGGAATTCCCAATTATGAATTTAAACTTGGTAAGATAACTTTCATCAGAAATTCACGTCCC
CTTGTCAAAAAGGTTGAAGAGGATGAAGCTGGAGGCAGATTCGTCGCTTTCTCTGGAGAAGGACAGTCATTGCGTAAAAAGGGAAG
AAAGCCCTAAGTGAGGACTGTTGGCTGATTGGAAAATAATAAAAGAATCATTTGCAACATCTTGGCTTTTAGTTACTGGCACTGAC
AGGGACGAGCCTCATCAGAGAATACTCTGTTACTTAAGATTTATTTAGAGTTACCTAAGAATTATTAAGTTTGACTTGGAAGTGGA
GCAGCAGGACTTTGTAGTTGTATGCTTGATTTGGGGAAAGACAAAGAGCTGTCCCTGAGGGCCTGTAGATAGCTGCCTCCTCACCT
CTTCACGCTTTCAGCTTGAGGGGAGCTCCCACTGCCTCAGCAGGAGCAATTCTGCATCCCTAATTCTGTCAAAACCTATGAAGGTG
ACTAAATTGTCTAACATGAAGTGTTCTTTCTTTTTCTTCATTTATCCTTTCTTTTCCTACATCAATTGCATAGGTGTCAGTCTTTG
GCCTAAAAAAAGGCTTTAAATAGACATGTGTTCTATAAGTAGTGGCTGTCCCACTACTGTGGCTGCAATTTA

73 TGATTGGCTTAAATGCCAATGTAGTTTGTTTCTTTGTCTTTGTACCTGGTTCTCTTTTCTGTTTCTTTTCTAATCTTTGTTTTAGG
CCTTCTAGTTCCACACCATCTTCTTGAGGGCTTCCTTCAGTATTTTCATTCTTAATTTTCTTTTTATTTTTCTTTTCTGCCTCTGC
TTTCATTTCTATGGTTANTCGTGGAANGACTCNTTGACCACGCGGAGAAGGNAAAACTTCAGGCANNTTGNGGTGTTTTTCCCCCT
TGGNCCTTCCCCCCTTTCCCAGGGAAGNCGAACTTGNTCA

74 CGGCGGACGACCCACCTTGAGATGCATCTAGCGACTGCTCCCAGCATGTAGGAGCAGTTGTAAAATCACAGCCGTAACAGTCCCTG
CTCTCCAGTGTCTGAAAACAAATGTTTTTCTGGTCTTCACTTTTTTGAGGCAGGAAGGATCTTTCGAAGATGGTTTGGCTGCCTTG
GAGATTTGGAGATCTGATGCCACGATGAGGACTCACACACGGGGGCTCCCAGTGTGTTTTTCATATATTTGCTTTGCTTTGTGTC
AGCCTACATCACCGACGAGAACCCAGAAGTTATGATTCCCTTCACCAATGCCAACTACGACAGCCATCCCATGCTGTACTTCTCCA
GGGCAGAAGTGGCGGAGCTGCAGCTCAGGGCTGCCAGCTCGCACGAGCACATTGCAGCCCGCCTCACGGAGGCTGTGCACACGATG

TABLE 1-continued

Sequences Table. First column: SEQ ID No. Second column: corresponding mRNA sequence. For the 3 different groups, see explanation in the text.

CTGTCCAGCCCCTTGGAATACCTCCCTCCCTGGGATCCCAAGGACTACAGTGCCCGCTGGAATGAAATTTTTGGAAACAACTTGGG
TGCCTTGGCAATGTTCTGTGTGCTGTATCCTGAGAACATTGAAGCCCGAGACATGGCCAAAGACTACATGGAGAGGATGGCAGCGC
AGCCTAGTTGGTTGGTGAAAGATGCTCCTTGGGATGAGGTCCCGCTTGCTCACTCCCTGGTTGGTTTTGCCACTGCTTATGACTTC
TTGTACAACTACCTGAGCAAGACACAACAGGAGAAGTTTCTTGAAGTGATTGCCAATGCCTGCAGGGTATATGTATGAAACTTCATA
CAGGAGAGGATGGGGATTTCAATACCTGCACAATCATCAGCCCACCAACTGTATGGCTTTGCTCACGGGAAGCCTAGTCCTGATGA
ATCAAGGATATCTTCAAGAAGCCTACTTATGGACCAAACAAGTTCTGACCATCATGGAGAAATCTCTGGTCTTGCTCAGGGAGGTG
ACGGATGGCTCCCTCTATGAAGGAGTTGCGTATGGCAGCTACACCACTAGATCACTCTTCCAATACATGTTTCTCGTCAGAGGCA
CTTCAACATCAACCACTTTGGCCATCCGTGGCTTAAACAACACTTTGCATTTATGTATAGAACCATCCTGCCAGGGTTTCAAAGGA
CTGTGGCTATTGCGGACTCAAATTACAACTGGTTTTATGGTCCAGAAAGCCAATTAGTGTTCTTGATAAATTTGTCATGCGTAAT
GGCAGTGGTAACTGGCTAGCTGACCAAATCAGAAGGAACCGTGTGGTGGAAGGTCCAGGAACACCATCCAAAGGGCAGCGCTGGTG
CACTCTGCACACAGAATTTCTCTGGTATGATGGCAGCTTGAAATCGGTTCCTCCTCCAGACTTTGGCACCCCTACACTGCATTATT
TTGAAGACTGGGGTGTCGTGACTTATGGAAGTGCACTACCTGCAGAAATCAATAGATCTTTCCTTTCCTTCAAGTCTGGAAAACTG
GGGGGACGTGCAATATATGACATTGTCCACAGAAACAAATACAAAGATTGGATCAAAGGATGGAGAAATTTTAATGCAGGGCATGA
ACATCCTGATCAAAACTCATTTACTTTTGCTCCCAATGGTGTGCCTTTCATTACTGAGGCTCTGTACGGGCCAAAGTACACCTTCT
TCAACAATGTTTTGATGTTTTCCCCAGCTGTGTCAAAGAGCTGCTTTTCTCCCTGGGTGGGTCAGGTCACAGAAGACTGCTCATCA
AAATGGTCTAAATACAAGCATGACCTGGCAGCTAGTTGTCAGGGGAGGTGGTTGCAGCAGAGGAGAAAAATGGGGTGGTTTTCAT
CCGAGGAGAAGGTGTGGGAGCTTATAACCCCAGCTCAACCTGACAGATGTTCAGAGGAATCTCATCCTCCTACATCCACAGCTGC
TTCTCCTTGTAGACCAAATACACCTGGGAGGAGAGTCCCTTGGAGACAGCAGCGAGCTTCTTCCATAATGTGGATGTTCCTTTTT
GAGGAGACTGTGGTAGATGGTGTCCATGGGCTTTCATCAGGCAGAGAGATGGTCTCTATAAAATGTACTGGATGGACGATACTGG
CTACAGCGAGAAAGCAACCTTTGCCTCAGTGACATATCCTCGGGCTATCCCTACAACGGGACAAATATGTGAATGTCACCATGC
ACCTCCGAAGTCCCATCACCAGGGCAGCTTACCTCTTCATAGGGCCATCTATAGATGTTCAGAGCTTCACTGTCCACGGAGACTCT
CAGCAACTGGATGTGTTCATAGCCACCAGCAAACATGCCTACGCCCACATACCTGTGGACAGGTGAGGCCACAGGACAGTCTGCCTT
TGCACAGGTCATTGCTGATCGTCACAAAATTCTGTTTGACCGGAATTCAGCCATCAAGAGCAGCATTGTCCCTGAGGTGAAGGACT
ATGCTGCTATTGTGGAACAGAACTTGCAGCATTTTAAACCAGTGTTTCAGCTGCTGGAGAAGCAGATACTGTCCCGAGTCCGGAAC
ACAGCTAGCTTTAGGAAGACTGCTGAACGCCTGCTGAGATTTTCAGATAAGAGACAGACTGAGGAGGCCATTGACAGGATTTTGC
CATATCACAGCAACAGCAGCAGCAGCAAAGCAAGTCAAAGAAAAAACCGAAGGGCAGGCAAACGCTATAAATTTGTGGATGCTGTCCCTG
ATATTTTTGCACAGATTGAAGTCAATGAGAAAAAGATTAGACAGAAAGCTCAGATTTTGGCACAGAAAGAACTACCCATAGATGAA
GATGAAGAAATGAAAGACCTTTTAGATTTTGCAGATGTAACATACGAGAAACATAAAAATGGGGGCTTGATTAAAGGCCGGTTTGG
ACAGGCACGGATGGTGACAACTACACACAGCAGGGCCCCATCACTGTCTGCTTCCTATACCAGGTTGTTCCTGATTCTGAACATTG
CTATTTTCTTTGTCATGTTGGCAATGCAACTGACTTATTTCCAGAGGGCCCAGAGCCTACATGGCCAAAGATGTCTTTATGCAGTT
CTTCTCATAGATAGCTGTATTTTATTATGGTTGTACTCTTCTTGTTCCCAATCACAGTGTTAGCACTGAAGCTATAAATTACCTGG
TCATTTTGTGATCACAAGAGTCTATGCAAAAAAAAAAATTTCTTTACCCCAGATTATCAGATTTTTTTCCCTCAGATTCATTTTAA
CAAATTAAGGGAAGATATTTTGACACAAGAAAGCAGGAACGTGGAGAAATTGGAGCAGGAAAAGAAATTATCAAAGCAATAGAAAT
AGCTTGGTGGTCCTATGGTGTTTTTGGAAGTATTTGGCATTGCTAATTGAGCAGTCCATATAGTACTACTTTTAGAAGAAACAAAA
AGTCTGTTTTTAAAGTAATGTTTTTCTTATGAGAAAAAGGTTTAGATAGAATTGGGTTTTATTAATATTAATTTAATGCTATTA
GCAATTTCCATATACTATATTGTGGAAAAAGACTGAAGAAATACAATTTTAAGGATACTCATGTTG
AAAGATAAATGTTGCTAAGTCCTGGTATGATGGTGTGAGCTTCCTTGGGGAAGTACTTCTTGAGTTATGTAACTAACAGGATGTTT
TACTACAGATCTGGATGGCTATTCAGATAACATGGCAAAAAATGATAGCAGAAGATCATTAAAAACTTAAAATATATTTTATTAGA
AAACATTTATCTATGAATGAATATTTCCTTGATGCTGGTCTCTGCACACATATGCTTGGTTACTTGCATGCATTCATTGGTTGTTC
AATAAGTGAGATGATTACAGATAACTTAATACTGTATTTTCCTTATATGGAAAACCGTTATAGACCCAATAACAACTAAACCTTTC
AAAAGAAAATATTTCTATTATGAATGTTGATTTTCATACCAAAGAAGATGGAGAGTCTAAAATTTGGATATGATTCTTATGTTTT
TTTAATAGAAAACCTTCTTCAAGTTTATTTTCCTAAATAAACATCATAATTGTGAATTTAAAAAAAAAAAAAAAAAAAAAAAAAAA
AAAAAAAAAAAAAGAAAAAAAAAAAAAAAA

75 GAGCAGCGCGGCCTGACGGGACCAAGGCGGCGGGAGTCTGCGGTCGTTCCCTCGGCTGTGGACCGGGCGGCACGCACGCGGTGCAG
GGTAACATGGCGGATGCGGAAGTAATTATTTTGCCAAAGAAGACATAAGAAGAAAAAGGAGCGGAAGTCATTGCCAGAAGAAGATGT
AGCCGAAATACAACACGCTGAAGAATTTCTTATCAAACCTGAATCCAAAGTTGCTAAGTTGGACACGTCTCAGTGGCCCCTTTTGC
TAAAGAATTTTGATAAGCTGAATGTAAGGACAACACACTATACACCTCTTGCATGTGGTTCAAATCCTCTGAAGAGAGAGATTGGG
GACTATATCAGGACAGGTTTCATTAATCTTGACAAGCCCTCTAACCCCTCTTCCCATGAGGTGGTAGCCTGGATTCGACGGATACT
TCGGGTGGAGAAGACAGGGCACAGTGGTACTCTGGATCCCAAGGTGACTGGTTGTTTAATCGTGTGCATAGAACGAGCCACTCGCT
TGGTGAAGTCACAACAGAGTGCAGGCAAAGAGTATGTGGGGATTGTCCGGCTGCACAATGCTATTGAAGGGGGGACCCAGCTTTCT
AGGGCCCTAGAAACTCTGACAGGTGCCTTATTCCAGCGACCCCCACTTATTGCTGCAGTAAAGAGGCAGCTCCGAGTGAGGACCAT
CTACGAGAGCAAAATGATTGAATACGATCCTGAAAGAAGATTAGGAATCTTTTGGGTGAGTTGTGAGGCTGGCACCTACATTCGGA
CATTATGTGTGCACCTTGGTTTGTTATTGGGAGTTGGTGGTCAGATGCAGGAGCTTCGGAGGGTTCGTTCTGGAGTCATGAGTGAA
AAGGACCACATGGTGACAATGCATGATGTGCTTGATGCTCAGTGGCTGTATGATAACCACAAGGATGAGAGTTACCTGCGGCAGCT
TGTTTTACCCCTTTGGAAAAGCTGTTGACATCTCATAAACGGCTGGTTATGAAAGACAGTGCAGTAAATGCCATCTGCTATGGGCCA
AGATTATGCTTCCAGGTGTTCTTCGATATGAGGACGGCATTGAGGTCAGGAGATTGGTTATCACCACCAAAGGAGAAGCA
ATCTGCATGGCTATTGCATTAATGACCACAGCGGTCATCTCTACCTGCGACCATGGTATGATAGCCAAGATCAAGAGAGTGATCAT
GGAGAGAGACACTTACCCTCGGAAGTGGGGTTTAGGTCAAAGGCAAGTCAGAAGAAGCTGATGATCAAGCAGGGCCTTCTGGACA
AGCATGGGAAGCCCACAGACAGCACACCTGCCACCTGGAAGCAGGAGTATGTTGACTACAGTGAGTCTGCCAAAAAAGAGGTGGTT
GCTGAAGTGGTAAAAGCCCCGCAGGTAGTTGCCGAAGCAGCAAAAACTGCGAAGCGGAAGCGAGAGAGTGAGAGTGAAAGTGACGA
GACTCCTCCAGCAGCTCCTCAGTTGATCAAGAAGGAAAAGAAGAAGAGTAAGAAGAGTCAAGAAGGCCAAAGCTGGCTGTGGAGAGCG
GGGCCGAGCCTGGAGATGGGGACAGTGATACCACCAAGAAGAAGAAGAAGAAGAAAGCAAAAGAGGTAGAATTGGTTTCTGAG
TAGTGAAGGCCACTTGAAGCTGGAGGAGAAACTAAAGCCTTATTGAGAAAACATGTTATAGATCCTTTTGTTGCTGAGAGAGTGGA
ACATAGGTCCTAGACAGGGTGAAGAGTTCTGGCACATTTTAGCTGCTACTTTGAGACCTCGGTGATGTTACCTGGTGTGGTCATCC
CATCTTGTCCTGTTTTAAGGATATGGGTGGTGAAAGATGAAAGAGGCAGAGTTTATCCCAATGACTTCTCTGTTTGAGTTGGGAAG
CCTCACCTTCAGACCCAGTAACTGTCCGCAGCTGTCTGCTAGTGGTCTTTAACATCGTAGTCCTAGTTTGCATTTTTTAAATCC
CCTCTGTTTAAAAGGTTTGTAAAACAAAACAAAAAAACTAAGTCTGCTCAGTGAAATGCTGTAGAACCCTAAATAAGTGGTAGAAG
AGTGTCACTGAATTTTGTCTCTGAATTCAGTATAACTGAGTTTTGTCCATGCTGGTGTCTGGGTTATAGGCCTGATGGGCCTGGTA
GTTTTCCATCTTGTTCTGGCCTAGAGGTCAGTCCTTTGCACTTCCTCAAAGCTTGTGTACAGTGCTCACCTAAATCCATCTGACTA
CTTGTTCCTGTGCCCTCTTGTTTTAGGCCTCGTTTACTTTTAAAAAATGAAATTGTTCATTGCTGGGAGAAGAATGTTGTAATTTT
TACTTATTAAAGTCAACTTGTTAAGTTTTTTTATGTATTCCTGTTGGGTTTTCTTGTTGATCTCATGCTAGCAGAGCAAAATTGTA
AAATATTTTGATTAAAAATCTAGGGACCTTTATGTCCTATTTGGAATTCGATATCAA

TABLE 1-continued

Sequences Table. First column: SEQ ID No. Second column: corresponding mRNA sequence. For the 3 different groups, see explanation in the text.

76 CGGGTGTTGTAAGATCTGGGGAGAGGGGAAGTACTGGCTCCTTCTAATCAGCAACACTGTGTGGGCATACAATGGAGGAATCCAGT
AATGGAAACTATAGGCCTGAGTAATTTAGAACAGAATTTCACAATTATATACAGCATATAGGTAGGGAAGGACATGGAGTATATAA
TTGTAAATATTGTGTGGGCTCCGCGCGCTGCGGGCTGCGGCAGGGTCCGGCCGGATGTCTCTGCAGAGCCTGGAGTTTGCATGAAA
CTTTCACCTGCGCTCCGGGGAGACTTTCGGTTCCGGCTCCCACCGCGCGCCTCGCCGCCCTCGCGACCGCGGGCTCCGTCCAACCC
GGCCCGACATGGACGTGCTCCCCATGTGCAGCATCTTCCAGGAGCTCCAGATCGTGCACGAGACCGGCTACTTCTCGGCGCTGCCG
TCTCTGGAGGAGTACTGGCAACAGACCTGCCTAGAGCTGGAACGTTACCTCCAGAGCGAGCCCTGCTATGTTTCAGCCTCAGAAAT
CAAATTTGACAGCCAGGAAGGATCTGTGGACCAAATCATTCTTGGCTCGGGAGAAAAAGGAGGAATCCGAACTGAAGATATCTTC
CAGTCCTCCAGAGGACACTCTCATCAAGGCCCGAGCTTTTGGTTACAACTTAGAGACCAACAGCCTGAACTCAGATGTCAGCAGCG
AATCCTCTGACAGCTCCGAGGAACTTTCTCCCACGGCCAAGTTTACCTCCGACCCCATTGGCGAAGTTTTGGGTCAGCTCGGGAAA
ATTGAGCTCCTCTGTCACCTCCACGCCTCCATCTTCTCCGGAACTGAGCAGGGAACCTTCTCAACTGTGGGGTTGCGTGCCCGGGG
AGCTGCCTTCGGCCAGGGAAGGTGCGCAGCGGACTTCGGGGAAGCCAGGTGACAAGGGAAATGGCGATGCCTCCCCCGACGGCAGG
AGGAGGGTGCACCGGTGCCACTTTAACGGCTGCAGGAAAGTTTACACCAAAAGCTCCCTTCACCAGTGCACTCGCACGAGGC
TACCTCGAGCGGGCCTGGGGTTTCCTAAATGAAACTCAAGGGTCAGGACAGAGGGTTGCTGGGCAGCGTGGAGTGTGTGGGTTGA
TGCTGACGGCCCGAGGCCCGAGTGGGACCGGCCTGCTCTGTAAGCAGCAGCATTGATCAGCGAGTGTTTCCTGAGAACTTCTCCGT
GTCTCATGCAGCCTTTGTTTCTGATACCGCTTGAAACAGTTTCTTAATGAAATGCCATACCTAGGTGAAAGTGCCATTTAAAAATA
CCTTGACATGTTCTAGGATAATTGGTGAGGAATCACAGAACATTTAGAACTGGAAGGGTCTTAGTGATCACGTGATGCAGGCTCT
TCTCTTATCAGTAGGAGAGCAAATTGCTGAGAGTCAGTCCCAGACAGGCTTGGTGACAGCTGAGATTGAGATCCGGGTGGCCCAAT
ATCCAGGCCCAGGCCTGTCTCAACATACCCTGAGATTGGCTTGACAACTTTGTTTTCTCAGGTAGCACTTGTAGTAAATTCATATT
TATGATTTGACCAAGGAATGAAGTGAACCCAGTTGTTCAATTGCCATTTAGAGAATGATTCCGGGGCCCTGTACTGGGGCTTTCCA
GAAGCTCGTAACTTCAGCTLTGTAGAAAGGTAGAACGTCCCTGAGGAAACTGGACAGGCACATTCCATAGGGAAGTGAGGATGGAA
CAGAAGTGTGTTTGGGAGAAACAGTTGCCATGAAGAAAGCAATAGCTCTGCCTTTGCCGGGGCTGTGGGTCCGGCAGGCTGACACC
TCATCCCGCAAGCATTTTGCTGGTCTGAGTCGTGGTCGTTCTTCCACGTTAACTTTGATGACAGCACCATGGGCTTGGCTGAAGCT
GTGTCCCTTGGACAGCAGTGGGAGGCCTGAGACTGGGTCAGGAGAGAGCTGCTGTTGTCTCTGAGGCTGCCAGTTGTTGTGTGT
TACCGATGCCAGAAGCCACTGGGTCCCTCCTCACATGGCAGAAGAAATGGAAAGGAAAGAACCTTCTCACTCTCCCCAGCCTTTTT
ATAAGGGCTCTAATCCCACCTGTGAGGGCTCTGTCCTCATCACTTAATCACCTCCTAAAGGCCCCACTTCTTACTACTATCACATT
GACCATTAAGTTTCAACATACAACTTTTCATGGACACATTCAGACCATACGTAGCACCTGCTGAAGAACATCTTGGTTCCTTCCAA
GTTTTGGCAAGTATGAATAAAGCTGCTATAAACATGAAAAAAAAAAAAAAAAAAAAAAAAAAAAA

77 AGCAAACCAATCGCAAGCCTCGTTGAGTGGAAGGGGTGGGATCTTCCCCGGAAGTTTTGGTTAAAGCCCCTCCAATCAGCGGCTCG
GTGCGGCAAGTTTGAATTTCGTGGAGGCTCGGGTTGTGAGGGTTCCTGCTTCGGAGTCGGCGGTGGTCGTCCAGACCGAGTGTTCT
TTACTTTTTGTTTGGTTGAGGTTTCACGCTAGAAGGTGGCTCAGGATGTCTTCATCACATTTTGCCAGTCGACACAGGAAGGATAT
AAGTACTGAAATGATTAGAACTAAAATTGCTCATAGGAAATCACTGTCTCAGAAAGAAAATAGACATAAGGAATACGAACGAAATA
GACACTTTGGTTTGAAAGATGTAAACATTCCAACCTTGGAAGGTAGAATTCTTGTTGAATTAGATGGAGACATCTCAAGAGCTTGTT
CCAGAAAAGACCAATGTTAAGCCAAGGGCAATGAAAACTATTCTAGGTGATCAACGAAAACAGATGCTCCAAAAATACAAAGAAGA
AAAGCAACTTCAAAAATTGAAAGAGCAGAGAGAGAAAGCTAAACGAGGAATATTTAAAGTGGGTCGTTATAGACCTGATATGCCTT
GTTTTCTTTTATCAAACCAGAATGCTGTGAAAGCTGAGCCAAAAAAGGCTATTCCATCTTCTGTACGGATTACAAGGTCAAAGGCC
AAAGACCAAATGGAGCAGACTAAGATTGATAACGAGAGTGATGTTCGAGCAATCCGACGTTCGAGCAATCGAACGCAACTTCTGAAAAGAA
AGTGTCAGACAAAGAAAAAAGTTGTGCAGCCTGTAATGCCCACGTCGTTGAGAATGACTCGATCAGCTACTCAAGCAGCAAAGC
AGGTTCCCAGAACAGTCTCATCTACCACAGCAAGAAGCCAGTCACAAGAGCTGCTAATGAAAACGAACCAGAAGGAAAGGTGCCA
AGTAAAGGAAGACCTGCCAAAAATGTAGAAACAAAACCCGACAAGGGTATTTCTTGTAAAGTCGATAGTGAAGAAATACTTTGAA
TTCACAATCTAATGCAACAAGTGGAATGAATCCAGATGGAGTCTTATCAAAAATGGAAAACTTACCTGAGATAAATACTGCAAAAA
TAAAAGGGAAGAATTCCTTCGCACCTAAGGATTTTATGTTTCAGCCACTGGATGGTCTGAAGACTATCAAGTAACACCTATGACT
CCCAGAAGTGCCAATGCTTTTTTGACACCCAGTTACACCTGGACTCCTTTAAAAACAGAAGTTGATGAGTCTCAAGCAACAAAAGA
AATTTTGGCACAAAAATGTAAAACTTACTCTACCAAGACAATACAGCAAGATTCAAATAAATTGCCATGTCCTTTGGGTCCTCTAA
CTGTTTGGCATGAAGAACATGTTTTTAAATAAAAATGAAGCTACTTCTAAAAATTTAAATGGCCTTCCAATAAAAGAAGTCCCATCA
CTTGAAAGAAATGAAGGTCGAATTGCTCAGCCCCACCATGGTGTGCCATATTTCAGAAATATCCTCCAGTCAGAAACTGAGAAATT
AACTTCACATTGCTTGAGTGGGACAGGAAACTTGAATTGGACATTCCAGATGATGCTAAAGATCTTATTCGCACAGCAGTTGGTC
AAAACAAGACTCCTTATGAAGGAAAGGTTTAAACAGTTTGAAGGACTGGTTGATGATTGTGAATATAAACGAGGTATAAAGGAGACT
ACCTGTACAGATCTGGATGGATTTTGGGATATGGTTAGTTTTCAGATAGAGATGTAATCCACAAATTCAACAATCTGATCAAACT
TGAGGAATCTGGGTGGCAAGTCAATAATAATATGAATCATAATATGAACAAAAATGTCTTTAGGAAAAAAGTTGTCTCAGGTATAG
CAAGTAAACCAAAACAGGATGATGCTGGAAGAATTGCAGCGAGAAATCGCCTAGCTGCCATAAAAAATGCAATGAGAGAGAGAATT
AGGCAGGAAGAATGTGCTGAAACAGCAGTTTCTGTGATACCAAAGGAAGTTGATAAATAGTGTTCGATGCTGGATTTTCAGAGT
TGAAAGTCCTGTTAAATTATTCTCAGGACTTTCTGTCTCTTTCTGAAGGCCCTTCTCAAAGACTTGGAACACCTAAGTCTGTCAACA
AAGCTGTATCTCAGAGTAGAAATGAGATGGGCATTCCACAACAAACTACATCACCAGAAAATGCCGGTCCTCAGAATACGAAAAGT
GAACATGTGAAGAAGACTTTGTTTTTGAGTATTCCTGAAAGCAGGAGCAGCATAGAAGATGCTCAGTGTCCTGGATTACCAGATTT
AATTGAAGAAACCATGTTGTAAATAAGACAGACTTGAAGGTGGATTGTTTATCCAGTGAGAGAATGAGTTTGCCTCTTCTTGCTG
GTGGAGTAGCAGATGATATTAATACTAACAAAAAAGAAGGAATTTCAGATGTTGTGGAAGGAATGGAACTGAATTCTTCAATTACA
TCACAGGATGTTTTGATGAGTAGCCCTGAAAAAAATACAGCTTCACAATAAGAAGAGGGGAAACTAAAATTTCTCA
GTCAGAACTATTTGATAATAAAAGTCTCACTACTGAATGCCACCTTCTTGATTCACCAGGTCTAAACTGCAGTAATCCATTTACTC
AGCTGGAGAGGAGACATCAAGAACATGCCAGACACATTTCTTTTGGTGGTAACCTGATTACTTTTTCACCTCTACAACCAGGAGAA
TTTTGAATTTAAAAATAAATCCAAACATTTTTCCTTCATATTATCAATGCTTATATATTCCTTAGACTATTGAAATTTTGGAGAAAA
TGTATTTGTGTTCACTTCTATAGCATATAATGTTTTAATATTCTGTGTTCATCAAAGTGTATTTTAGATATACTCTTTCTCAAGGG
AAGTGGGGATATTTTGTACATTTTCAACACAGAATAAAAAATGTACTGTGCCTTG

78 GGCGGGAGGAGAGTCGGCGGCCGGAGCCGTCACCCCGGGCGGGGACCCAGCGCAGGCAACTCCGCGCGGCGGCCCGGCCGAGGGAG
GGAGCGAGCGGGCGGGCGGGACCAGCAGCTGGGCCGGACGCCGGGCGCCCGAGGGGCCGAGCGAGATTGTAAACCATG
GCTGTGTGGATACAAGCTCAGCAGCTCCAAGGAGAAGCCCTTCATCAGATGCAAGCGTTATATGGCCAGCATTTTCCCATTGAGGT
GCGGCATTATTTATCCCAGTGGATTGAAAGCCAAGCATGGGACTCAGTAGATCTTGATAATCCACAGGAGAACATTAAGGCCACCC
AGCTCCTGGAGGGCCTGGTGCAGGAGCTGCAGAAGAAGGCAGAGCACCAGGTGGGGAAGATGGGTTTTTACTGAAGATCAAGCTG
GGGCACTATGCCACACAGCTCCAGACACGTATGACCGCTGCCCCATGGAGCTGGTCCGCTGCATCCGCATATATTGTACAATGA
ACAGAGGTTGGTCCGAGAAGCCAACAATGGTAGCTCTCCAGCTGGAAGCCTTGCTGATGCCATGTCCCAGAAACACCTCCAGATCA

TABLE 1-continued

Sequences Table. First column: SEQ ID No. Second column: corresponding mRNA sequence. For the 3 different groups, see explanation in the text.

ACCAGACGTTTGAGGAGCTGCGACTGGTCACGCAGGACACAGAGAATGAGTTAAAAAAGCTGCAGCAGACTCAGGAGTACTTCATC
ATCCAGTACCAGGAGAGCCTGAGGATCCAAGCTCAGTTTGGCCCGCTGGCCCAGCTGAGCCCCAGGAGCGTCTGAGCCGGGAGAC
GGCCCTCCAGCAGAAGCAGGTGTCTCTGGAGGCCTGGTTGCAGCGTGAGGCACAGACACTGCAGCAGTACCGCGTGGAGCTGGCCG
AGAAGCACCAGAAGACCCTGCAGCTGCTGCGGAAGACAGCAGACCATCATCCTGGATGACGAGCTGATCCAGTGGAAGCGGCGGCAG
CAGCTGGCCGGGAACGGCGGGCCCCCCGAGGGCAGCCTGGACGTGCTACAGTCCTGGTGTGAGAAGTTGGCCGAGATCATCTGGCA
GAACCGGCAGCAGATCCGCAGGGCTGAGCACCTCTGCCAGCAGCTGCCCATCCCCGGCCCAGTGGAGGAGATGCTGGCCGAGGTCA
ACGCCACCATCACGGACATTATCTCAGCCCTGGTGACCAGCACGTTCATCATTGAGAAGCAGCCTCCTCAGGTCCTGAAGACCCAG
ACCAAGTTTGCAGCCACTGTGCGCCTGCTGGTGGGCGGGAAGCTGAACGTGCACATGAACCCCCCCCAGGTGAAGGCCACCATCAT
CAGTGAGCAGCAGGCCAAGTCTCTGCTCAAGAACGAGAACACCCGCAATGATTACAGTGGCGAGATCTTGAACAACTGCTGCGTCA
TGGAGTACCACCAAGCCACAGGCACCCTTAGTGCCCACTTCAGGAATATGTCCCTGAAACGAATTAAGAGGTCAGACCGTCGTGGG
GCAGAGTCGGTGACAGAAGAAAAATTTACAATCCTGTTTGAATCCCAGTTCAGTGTTGGTGGAAATGAGCTGGTTTTTCAAGTCAA
GACCCTGTCCCTGCCAGTGGTGGTGATCGTTCATGGCAGCCAGGACAACAATGCGACGGCCACTGTTCTCTGGGACAATGCTTTTG
CAGAGCCTGGCAGGGTGCCATTTGCCGTGCCTGACAAAGTGCTGTGGCCCACAGCTGTGTGAGGCGCTCAACATGAAATTCAAGGCC
GAAGTGCAGAGCAACCGGGGCCTGACCAAGGAGAACCTCGTGTTCCTGGCGCAGAAACTGTTCAACAACAGCAGCAGCCACCTGGA
GGACTACAGTGGCCTGTCTGTGTCCTGGTCCCAGTTCAACAGGGAGAATTTACCAGGACGGAATTACACTTTCTGGCAATGGTTTG
ACGGTGTGATGGAAGTGTTAAAAAAACATCTCAAGCCTCATTGGAATGATGGGGCCATTTTGGGGTTTGTAAACAAGCAACAGGCC
CATGACCTACTCATTAACAAGCCAGATGGGACCTTCCTCCTAGGATTCAGTGACTCAAGAAATTGGCGGCATCACCATTGCTTGGAA
GTTTGATTCTCAGGAAAGAATGTTTTGGAATCTGATGCCTTTTACCACCAGAGACTTCTCCATTCGGTCCCTAGCCGACCGCTTGG
GAGACTTGAATTACCTTATCTACGTGTTTCCTGATCGGCCAAAAGATGAAGTATACTCCAAATACTACACCACCAGTTCCCTGCAG
TCTGCTACTGCTAAAGCTGTTGATGGATACGTGAAGCCACAGATCAAGCAAGTGGTCCCTGAGTTTGTGAACGCATCTGCAGATGC
CGGGGGCGGCAGCGCCACGTACATGGACCAGCCCCTCCCAGCCTGTGTTCCCCAGGCTCACTATAACATGTACCCACAGAACC
CTGACTCAGTCCTTGACACCGATGGGGACTTCGATCTGGAGGACAATGGACGTAGCGCGGCGTGTGGAGGAGCTCCTGGGCCGG
CCAATGGACAGTCAGTGGATCCCGCACGCACAATCGTGACCCCGCGACCTCTCCATCTTCAGCTTCTTCATCTTCACCAGAGGAAT
CACTCTTGTGGATGTTTTAATTCCATGAATCGCTTCTCTTTTGAAACAATACTCATAATGTGAAGTGTTAATACTAGTTGTGACCT
TAGTGTTTCTGTGCATGGTGGCACCAGCGAAGGGAGTGCGAGTATGTGTTTGTGATGGTGTGTGTGTGTGTGTGTGTGTGCGTGTT
TGCACGTTATGGTGTTTCTCCCTCTCACTGTCTGAGAGTTTAGTGTAGCAGAGGGCCACAGACAGAAGCTGTGGTGGTTTTAC
TTTGTGCAAAAAGGCAGTGAGTTTCGTGAAGCCTGGAAGTTGGCCATGTGTCTTAAGAGTGGCTGGACTTTGACATGTGGCTGTTT
GAATAAGAGAAGGACAAAGGGAGGAGAAAGCACATGTGCTCCAGTGAGTCTTCGTCACTCTGTCTGCCAAGCAATTGATATATAAC
CGTGATTGTCTCTGCTTTTCTTCTGAAATGTAGATAACTGCTTTTTGACAAAGAGAGCCTTCCCTCTCCCCACCCCTGTGTTCTT
GGGTAGGAATGGGAAAAGGGGCAACCTACAAAGATTGTTGGGGCAAGGGAAGTCACAAGCTTTCGGATGGGCGGTGGCTTTTCACA
AAACATTTAGCTCATCTTATTCTCTCTTTGTCCTCTCTCCCCTCCTGCCCGCCCGCACCCTGGAATTGCCACTCAGTTCCTCTGGG
TGTGCACATATGTTTGGAGAAATAGAGGAGAGAAAAGAGGGCCACGTAACTGAGAGCTTACAGTGCCAATGCCGTTTGTGTTCTGG
CCAGAGTGGAGTGCGCAGCCCTGACTCTCCAGGCGCTGAGATTGTTGCCTGGTTACCCAGGAAGCTGCTGTTCCGGCTGCCCAGCCT
TTCTCTGAGCCAGCGGATGCACAGTCCGTGGCCTTCTTCAGGCTTATTGATGATGCTTTTTGCAAATGTTGAATCATGGTTCTGTT
TCTAAGTTGGATCTTTTTTGTTTTCTCCTTGCCACCCTAATTTGACATCAAAATTCTCTCTTGTGCATTGGGCCCTGGGTCATTCA
AACCCAGGTCACCTCATTCCCCTTCTCTGTTCACACCTAATGTCTTGAAGAGTAGGTAGCAGCAGTGTGGGCTGAACCTAGGCCAG
CTTGCTTAGCGGGTCACCCTGCTGTGAAGTCCTGGCAGGTGTTGGTAATGTGTGGAAATGCAGTCAGCAAGTTTGCTGGGGAGTTT
GATAAAGTATAAAACAAAACAAAAAAAGCCTCGGTATAATTTTGTTCCACGACTTCTTCTGTAGCTTTACACCAGAAGGAAGGAA
TGGGCTACAGCAGGTAGTGGAGGAAGAGGGGGGTGAGCAGGTGTATTAAAATAGCTTACGGGTAAGGCCTAAAAGGTCACCCCTCG
GCCCCCTCTCCAAAAGAAGGGCATGGGCACCCCAGGAGAGGATGGCCCCAAAAACCTTATTTTTATACATGAGAGTAAATAAACA
TATTTTTTTTACAAAATAACTTCTGAATTTATCAGTGTTTTGCCGTTAAAAATATTCCTCTATAGTAAATTATTTATTGGAAGAT
GACTTTTTAAAGCTGCCGTTTGCCTTGGCTTGGTTTCATACACTGATTTATTTTTTCTATGCCAGGCAGTAGAGTCTCTCTGCCTC
TGAGGAGCAGGCTACCCGCATCCCACTCAGCCCCTCCCTACCCCCTCAAGATTTGATGAAAATTCCAACCATGAGGATGGGTGCATC
GGGGAAGGGTGAGAAGGAGAGCCTGCCTGCTCAGGGATCCAGGCTCGTAGAGTCACTCCCTGCCCGTCTCCCAGAGATGCTTCACC
AGCACCTGCCTCTGAGACCTCGCTCTCTGTTCCAGCAACCCTGGTTGGGGGTCAGACTTGATACACTTTCAGGTTGGGAGTGGAC
CCACCCCAGGGCCTGCTGAGGACAGAGCAGCCAGGCCGTCCTGGCTCACTTTGCAGTTGGCCACTGGGTTGGGGAGGAAGAGAGCTG
ATGAGTGTGGCTTCCCTGAGCTGGGGTTTCCCTGCTTGTCCAGTGTGAGCTGTCCTCGGTGTTACCGAGGCGTGCCTAGAGAGT
GGAGATTTTTGATGAAGGTGTGCTCGCTCTCTGCGTTCTATCTTCTCTCCTCCTTGTTCCTGCAAACCACAAGATAAAGGTAG
TGGTGTGTCTCGACCCCATCAGCCTCTCACCCACTCCCAGACACACACAAGTCCTCAAAAGTTTCAGCTCCGTGTGTGAGATGTGC
AGGTTTTTTCTAGGGGGTAGGGGGGAGACTAAAATCGAATATAACTTAAAATGAAAGTATACTTTTTATAATTTTCTTTTTAAAAC
TTGGTGAAATTATTTCAGATACATATTTTAGTGTCAAGGCAGATTAGTTATTTAGCACCAAAAAAAAGTATTGTGTACAATTTGG
GGCCTCAAATTTGACTCTGCCTCAAAAAAAGAAATATATCCTATGCAGAGTTACAGTCACAAAGTTGTGTATTTTATGTTACAAT
AAAGCCTTCCTCTGAAGGGAAAAAAAAAAAAAAAAAAAAAAAAAAAAAAAAAAAAAAAAAAAAAAAAAAAAAAAAAAAAAAAA
AAAAAAAAAA

79 ACCAGAGGTTTCCCAGAGAGGAAGGCGTGGCTCCCTCCCGGGCCAGTGAGCCCTGGCGCCGCCGCGGCCGCGGTCCCAGCAGCGGA
GTAGGGCGGCGGCTGCGCCCCGCACCATGGGGGGCAGCCCAGCCCCAGCCGCGGTAAACGCCGACCTCCGCCGCCGCCCGCGCCGC
GTCTGCCCCCTCCCGCTGCGGCTCTCTGGACGCCATCCCTCCTCCACCTCGAAGCCAACATGAAGGAGACCCGGGGCTACGGAGGG
GATGCCCCCTTCTGCACCCGCCTCAACCACTCCTACACACAGGCATGTGGGCGCCCGAGCGTTCCGCCGAGGCGCGGGGCAACCTCAC
GCGCCCTCCAGGGTCTGGCGAGGATTGCGGATCGGTGTCCGTGGCCTTCCCGATCACCATGCTGCTCACTGGTTTCGTGGGCAACG
CACTGGCCATGCTGCTCGTGTCGCGCAGCTACCGGCGCGGGAGAGCAAGCGCAAGAAGTCCTTCCTGCTGTGCATCGGCTGGCTG
GCGCTCACCGACCTGGTCGGGCAGCTTCTCACCACCCCGGTCGTCATCGTCGTGTACCTGTCCAAGCAGCGTTGGGAGCACATCGA
CCCGTCGGGGCGGCTCTGCACCTTTTTCGGGCTGACATGACTGTTTTCGGGCTCTCCTCGTTGTTCATCGCCAGCGCCATGGCGG
TCGAGCGGGCGCTGGCCATCAGGGCGCCGCACTGGTATGCGAGCCACATGAAGACGCGTGCCACCCGCGCTGTGCTGCTCGGCGTG
TGGCTGGCCGTGCTCGCCTTCGCCCTGCTGCCGGTGCTGGGCGTGGGCCAGTACACCGTCCAGTGGCCCGGGACGTGGTGCTTCAT
CAGCACCGGGCGAGGGGGCAACGGGACTAGCTCTTCGCATAACTGGGGCAACCTTTTCTTCGCCTCTGCCTTTGCCTTCCTGGGGC
TCTTGGCGCTGGACAGTCACCTTTTCCTGCAACCTGGCCACCATTAAGGCCCTGGTGTCCCGCTGCCGGCAAGGCCACATCATCTCT
CAGTCCAGTGCCCAGTGGGGCCGATCACGACCGAGACGGCCATTCAGCTTATGGGGATCATGTGCGTGCTGTCGGTCTGCTGGTC
TCCGCTCCTGATAATGATGTTGAAATGATCTTCAATCAGACATCAGTTGAGCACTGCAAGACACACACGGAGAAGCAGAAAGAT
GCAACTTCTTCTTAATAGCTGTTCGCCTGGCTTCACTGAACCAGATCTTGGATCCTTGGGTTTACCTGCTGTTAAGAAAGATCCTT
CTTCGAAAGTTTTGCCAGGTAGCAATGCTGTCTCCAGCTGCTCTAATGAGCTTAAGGCCCTGGTGTCCCGCTGCCAAGGGCCATCATCTT
CAGTCCAGTGCCCAGTGGGGCCGATCACGACCGAGACGGCCATTCAGCTTATGGGGATCATGTGCGTGCTGTCGGTCTGCTGGTC
TCCGCTCCTGATAATGATGTTGAAATGATCTTCAATCAGACATCAGTTGAGCACTGCAAGACACACACGGAGAAGCAGAAAGAT
AATAATACAGACAGAACATGAAAGAAAACACTTAACTTGCATGTGCACAGCTTTTGGTAACAAATATCGCTAAACGTTACTGTGA
ATTTAGGCATCTCTGGCATGCCACTGTTTATGCATTGAAGTGGAATTTTTGGTATAAAGCTAAATGGTCTTAGAAGCATAGAAAAT
CCCTATGTGCCAAAAGTAGTGAAACACAAACAAAGGAAAATATATTAATAACAGTCAGTGTTTTTGTTGAGTCTGCCATTCGTAG
CTGAATATGTGATTAATTATGTGATGAAAACATTTTTTATAAATGATCTTGGTCTATTGGGGAGCGGGATAGTTAATATTCCAGT
ACACTGAATACATGAGGAATTTAACCACATACATCATTGAAGACAAGGGATAGCAGTTTGTTTTTATTCAAAGACATTGCTGTGTT

TABLE 1-continued

Sequences Table. First column: SEQ ID No. Second column: corresponding mRNA sequence. For the 3 different groups, see explanation in the text.

CTCTTTCATTGCCTCTCTCGCTTTCTGTCACTTTTTTCCTCCTTACATTAAAGAAAAGTTTAATTACAGTTAAAAATGTATAATGT
ATTTATAATATTCATCGATACCATTATTCAAATATTGCTCAATACAGCAAATTAGCTCCTAACCTAACAAAGTTTAAGTTTACTTG
GATTGATAATTAGGTTTACTCTTTATCTGAATAAGAACCAATTCCATTTGTTTGAAATATGGAGTTTGTGACTACCCAAATTGCTA
ATTATTCTTTCTTTTGAATATATTTTACATTTCTATGAGCCTAAGGAAGATTCATGAAACTGACCTATGAGAGTCGTGAAGTGGTT
TTTCAGAATGCTATGTAAGGACCGATTTGAGCACTAACTATAGGTACTCTGAATATATATTTCCCTTGATTATTCACCAAAAGTGT
TCCCCAGTCTTTGACTCTTTAAATTCCAATACTGATTCCAAAACAAATAAATATTTTGAAGACTCAATGAATACTTTCCATATTTT
GGCCTATTTATATAAGAAAGTTAATAACATTGACCCTTCACAGCTCTTCTGCCTGCTCCTCAAAGTGGCTCTATCTAAATATTTAT
TACTAAAATGTTTTTCCTACAGTCTACATGAATACAAACCTCAATAGCTAAGCTTGACGTATTTGTGCACAAGTAGATCACTACAT
TAAGTTTTGGGAATTGCACTTCTTAAAAATGTCTCCCCACCAAACATAGTAATCCTGTAGTTATGCCTACACAAAGCTTGCCATAT
TCTTTGGTGCATTCATTTTGTAAACCCATTAACTTTTTATTGTGAAGATTTTCATTTGCAGTTTCTTGCACTGCTTTTCTAGTTTT
TTAAAAGCTTGAGATTTATTTATACTTCTTGTAGTAACTGCATATTTCTGTGTGTGTTTAGTGGTAAAGAATTAATTTTGATAGGT
ACAATATGTCTATCAGATTGATATATACACCAGCCTATGTCAATTGGGGCTAATTATTTTAAATGACCATGTCAAATTGAATTTGG
AGACAAAATCTGTTGAGAGTGCTTATGTAATTAATGATGGTTCTACTAATCTAAATTTTGGAAAAGGTGATAAATAGACTATACTA
AAATCTCTCTATGCCATAGAATTGGATTATCCTGTAGGTCATCTCATTGGGTATAAGACAAAACTACCTACTTTTTTTCAAAAGTG
CACTGAAATCACATAATAAAGAGGCTTTACCTCTTGGTTGGTCCTGTGACCCTAAGTTCTAGTCAGATAGACACAGAGGCAATGTG
AATTTGAGTGGCATGAGCATGATTAGGTTATTCCTTCCAGCATCTAGTATAGCACCTGGAATATAGAAACTGTCTAATACATATTT
ATTCAGTGAATCAATGAGCAGAAGTTTGCCAGGACAGTACACATTGGCAAGGCACATACCATATGATTGAAGTGCTTCATGCCATT
ACAGTCCATCAGGCTGATAAAGTGAATTATTTCTGATTATTTAATTACAGAAATATGAATTTATCTTCAAGGGTGTAGTGTCATAC
TGCTGTACAACACAGTGCTTTATTTATACTAATAATTTAGGAGACTGATACTTCCAAATGATAGTGGACATTACTATCACAAGAAT
ATCACTTTTCATCAAACTGCAAAATACAGAAAGGCAAAAAACCTGACACTTATTCTTAACTGCAAATTAAATTCCTGCCCAGGGG
ATATATTTTAGGAGGGGATGAATGGCAGCTTTTGTGTTTTTTAACAAGCTTGAAAGGGAGGTGGAAAACAAAGAAATTATGTAA
ATGGCATATGAGTTTTATTATCTAGGCATTCGTTAGTATGGGGAAACCTGATAAGAAATGAAAATCCCAAATGATTTCAGCCTTTT
CATGATGGTTGAGGTTAGATTTCAGAGATGTACAGAGACTAGAGCGGTGGTTAGAAAGAGGATATATGTAGTCACAGCAGAAAGAC
GTGTCTAAGTTTAATTTTATTGGCTTTCAAGTTCACTCATGTATACTTAGTTTGTCCATACATATGTCTAATCAGGAAAATGCAT
GTATAGATTATGACAATTCCTGAATTTTGAAGTATTGATTTAAAAGACAATTAAAGGCCAAGAAAACCATGGTGGAAGAAGTAAGCG
AATGAAATGTAGAAATATATGTAAAATTAGCAAGTGTCAATTTTACCAAGTAGTGTTGATTTTCCAAACAATGAATTTATATACTA
TGCTGAGTCACAGAGAAGAATGATCACATGTTACTTAATGAGAGCAGTTTACTTTTCAAATAAAATAGGTATGATGAATGTCTTAA
AAATATCTTGAAGTTGAAGAAACAAAAATGAGTTATCTCAATATTTACCAAGTTAACCTAGTGCTGTATATATCCCAAGATATTTT
AGGTAAATGTAAGTGTTTAATCATGCCAGATTTAAACTAGTCTGAAATATAGGGTATACATATATTTCTACTTACATTTCTTTATT
TTATGAAATATCCGACCATGTTGCAGAAAATAATGCAAAACCTCATGTAAGTTAACTATGAAAGATCCTGTGAGCACATTGGCATT
GAGTGACAGACAAACTAAAAACTGGCAAACAGTATTTTAATAAGGGGGTCACTCTGTGGCAGTATTCTAATATTGGATTTTCAAGT
AGATTAGGCTTTTTATTTATTCAACGCTTTTTATAATTTTGTTCTTTTTGACTCCAAATTATTGGTCAGCTTTCAACCTTCTCCAC
ATCAGCAATCACTAATAGTTCTTTTGGTTGAGATCAACTCAGAAAAAGAAAATAGAAAACTTTTGTTCTTTGAAATTTTAGACATG
CATAATATCTATTTATTTTCATAATTTAACCCCAAAAGCTTCTCCTGCAATACACAGGATTCTAGGAGCTGAATGACACAGGGAGA
CTACAGAGTATTTATTATTACAAACACATAAAAAGCCTAACTTGAAGAATTAAAATTTCTATTTTTTATCTGTATAACAAGTACAA
ACCATCAACAATGACAAATTTTCACAGCTGCTTGTTTATTGCTTGTTTTATATGTTTACATATCTCAAAATCTGTTAAAACTGAGG
TCTAAAAAATGTGCAGAATTGTGCAACTGTGGCCTAGTCCATAAGACTTTTCTGAGTTGCAACAAAGTGCTGACAAAGTGACAGAT
GTCTGTGATGTTTCATGACATAGGTTTATGATCGAGCCAATTTACAAAATTTAATAACCAACCTAAACTCACATACATATTTGTTAA
GAAGCTGACATCAGTTCAGTATTGTAAGGAAACTAACTAGGTGGTGATGATAAAAGAATTAGGGAAAATATTTTATTTGATAT
ATTCCCTTTTATAATTCCTAAAATGAAGATTCTATTTAAGGGTTATAATTTATATAAGTTTAGTCATATACCATTACATTATGATA
CCATAAGCAGAGTGCATTATGATTCTCTAGAAATATAATTCAATCAGATATGTATTATATTTATTTATGTCACACATTTTCTTTAC
TGAGAATAAAAATTATCTTATTTTCAGAAGCTTTGTATCAATCAGTTTCATGTAATAAGCAACCCAGATATCTACTAGATTATGTA
TTTCTTCATTTGAAACATACACTGTTTTCTCCTAGTCCCCTTGACTCTACTGTGCTTATCCATTCTTTCACAGAAAGAAAGTAACAG
ACATAATTCCTGTTGATGAGGCTGGGATTGTTTTTAAGAGGAGAGATAATAACTTCATATTTTTAAAGTGCCAGTAGCCTAATATG
TGAAACAGATCAGAATCTGTTGTGTAGTAAGTCTGCTTTGTTGAAGAATTTATTATGGGAGTAAAGATAAGAAGGAAAGAGATCAC
CATCAGAAACAAGTCAGCCTTTTCAGCTTTTTTGAGCATTTTTGGAGATGATTCCACTTCTCAAGTTATTATCATTTGTGCATCT
CTTCAATGCTATTGTAAATGCTTTAGAATTAGAATATTTTGATCCTTTAATTAAAGTAAGCCAAACGTCTAGGCAAAAACAGCCA
ATCATTAAACTTTAATAGTAATTCAAATATAGATTTCTCATACAGTTTTCCATGTCTGTAGAAATCAAAGTTGTAATGTTAAGCAG
AGGGAAATGCGTGTGATTTACTAATACACTTCAACGTTCTACTTTTGAAAGGATACTCATGTGGGTGGGGCAGAGAACATAGAAAA
AGATATGGAAAACCTGTCCATTTTCTACCTGTTAACCTTCATCATTTTGTGCCAGGCCCTGGAAGCAAAGAGAGGAAGGGACC
GACTGCATTTATCTTTGAACACTTGAGCATCAGTAGTACTACTGAGTGGCCAGGGGTCTTGTCTGTCAAAGCAAATGATAAGTTCA
CTCAGGCCATTATTGACTGCTGAACTCTCTTCCTTCCCAACTCTTCCTTGAAAGAGAAAAAATACTTTGCCTTCTTGCTCTCCTT
ATCAAATGTTTTTGTACAAATAGTGTAAGCCTGTTTAAGCAAACCAATTAAAATAGGCACTGATTATTTTGATCTGTTTGTAACAA
ATGAATGTAAGTACTATTTACATGGTGTGCCTAGGAGGAGCTGAAATTGGCACTTTAATCCATATTGTAAAGATCAGTATCAA
AAGCATAGTGTTCTTCACCTCTCCTCCTCAGCATCCATCTCTATATACTTGATTAAATGGAAAAGTCTCTTTTATCACCTCTATGT
AAAGTTTTATGGGTAGTTATCGTCAGTGTATTTAAATATATCTTCTAGTATGTTTAAAGGCTGGTCTTCAATACTGTGGAGACAA
AAAATAAAAGAGCGTATGAAAAGTACGTTAGACTTTTGCTGGCATTCAAGTCATGGCTAGTCTGTGTATTTAATAAATGTGTGTTA
TTTATGTCGTGTTTGTCAATGGAAAATAAAGTTGAATATTCTGAAATGTCGCTGTGTTTTCTTCCTGATGTCAACTCACGTCAGGA
ATACTTTACCTATAACTATGTTAAGTATTTTGCTGAAATCCCATTGATGTGCTTTGTCAAATAATAGACAATGTAATGCAACAG
CCCCATGCTATCTGGAAAAATTAGATCATTTTGTTTTATATTCCATAATCATGTGCATAACAAATTATTGTTGATTTAATATAAAT
ATGAGAGTTGCTCTTTTCCGATTTTCAACATGATGTTTCTTTGTTTTATTATCTCAAGATTATTGTTCTTAACACAGAGTGCATTT
ATAAATTATTGTAAGCTTAGTTATTTCCCTTTCTTGTGGATTTTGGTGTAATTTACAGGCAGCCAAAATAAGAATTGTCCTTGCTC
ATAGTACAACCCTTTAATTGCTTGTGCCTGAGTTTTGGTGTGAGCTGGATATTGGTGGTTATGAATACTGGGATCCCCAGCTATT
TGTTCATGTACTTATTGAGGTCACTATTGGTCTTCCTTCTTCAATGAAGGGAGAAGCTCTGTCAAATGTAGACTGCAAAGTCAAGC
TCATTAAAAGTATCCCTCTTCTTCGTGAGAAAAGATATCCAAGGAGAATTCTGTCCCTGGTTCCTCCCATGTGGGGTTCTAGGC
CTAGGACCAGATCTTATTGTCTCTACAATCTTGATTCTTTAGTATTTCAGGATAGGCAGAGTTTGTTAAAGTATACAAAAATCAT
AGCTAGATAAGAGAGATAACAGAAATAAGTTCCAGTGTTCTATACTCCTGTAGGATGACTACAGTTAATGTCCTAATATACAGTTACA
AATAGCTAGAAGGAGGCTATTGAATGTTCCCAACACAAAGAAATGATAAATGTTTGAGATGATGATGTGCTAATTACCCTCATCTG
ACCAGTACATTATATGTATCGAAACATCGCTCTGTGCCCTGCGAATATGTACAATTGTGATTATTAAAAATAAATACATAAATAA
AATTTAAAAGTCATTATGA

80 AAGAATTGATCTACCCACAATGTCAACAAGTACCCCTTTGAAAAACGCTACCAACTAAATGGGCTTTGGCAGGCCTTCCTGAGAAT
CTAAACACAATTTTTAATGTGGTTGCTCTGGCAGAGACTGCTGTCTCATCAGCCTATTTTAGACTACCAAACAAGTATGTTTGAA
TTATAAATTTAACCTCCACACCCATTTTCTTTTTTTAACTTTTTATTATGGAGACTTTTCTTTTTTTTTGAGATGGACTCTTAC
TCTGTCGCCCAGGCTGGAGTGCAGTGGCAGGATCTCAGCTCACTGCAACCTCCACCTCCCGGGTTCAACCAATCCTCCCTGCCTCA
GCCTCCTGAGTAGCTGGGATTACAGGTGCCCACCATCACGCCCGGCTGATTTTGTATTTTTAGTAGAGATGAGGTTTCGCCATTT

TABLE 1-continued

Sequences Table. First column: SEQ ID No. Second column: corresponding mRNA sequence. For the 3 different groups, see explanation in the text.

GGCCAGGCTGGTCTTGAACTCCTGACCTCAGGTGATCCACCCACCTCGACCTCCCAAAGTGTTGGGATTGCAGGCGTGAGCCACCA
TGCCTGGCTGAGACTTTCAAATTTATATAAAAGGGAGAAATTAGCCACCCAGCCTCAACAGGTTTTATCAATTCTGTTTCATTATC
TCCATCACCACCAACACCTCTTCGTCTTCTAATTGCTGGAGTATTTTAATGTAAATCTCATCCTATCCTTTCAACCAAAATTTCTG
CAATAGTGACTAATACATGCCCTTTTTTTGAAACATCATTATACGTAACAGTTGACAGCAGCTCTTAAGTGTCATCTAATATCCT
ATTTCATGTACAGATTTATCAGATTGACCCAGAATGTCTTTTTATAGTTTTTTGCTTTGTTTTGTTTTACAGTGGTTTGTTCAAA
CATGGATTCAGATAAGGTCCACACATTTTAGTCTGTAATAGTTTCTTCTCACCCTCTCTCACCTTTGTTTTCCTTCTATGTCATTT
ATTTGTTGAAGAAACTGGATCATTTTTCCTGTTGTGGAATTCCATATTCTGGGTTTGGCTGATTATATGTTTCTCTGTCTCTCTTA
CTTTCCATGAACTGGTGGTTAGACATAAAGACTTTCAGAACTGATTGGTAAGATATACATTTATTTCCATTGGATTGGAAGTCATA
ATATCTGATTATCCCCTTTTTTTTTTTGGTCATGTTGAGATTGATTATAGTAGTTCAGCTGTTGTAAGTCTATTCCACCCATAA
AGTTCCTCAGCAAACTTTAACCTAATGGTTTTAATAGTCATTGATGATGTTTAAATCCATTTCATTAAATGCTGCAAAATGGTGAT
ATTCTAATTTTTTAAATTCTAACTTCTGCATTCGTTAGCTGGAGTTTTTTCTACAAAGAGGGACTTTGCCATATCAGCTATTTGCT
TCAATTGTAATATGTAATGAAAAGGCAGGATTAGGTGCTTGTTTACTCATTTGCAGAATAATAACATTCCTTGAAAGTGACCAGTG
GGGTTTTAGGGTTTTTGTTTTGTTTTGCTTTCTTTTCATTTTGTTTTATTATGAGATCATGGTTTTTGTTGTGGTTGTTGTTATTGT
TGTTGTTTTGTATTGGTTATATTTTAGTCCACTCAGTCCACTAATATCACTTAGTTTTTATTACGGAAAATTTCAAACACTCTCAA
GTAGACAGAGTTGCACCATACAGTGAAACCTCTTATGTTCATTCTCAACGTCAACAGTGATCTTAACATTCAACCAATCTTATCT
TCATCTATACCTGTACTCCAGCCCCACTTTCTTCTGCCCTTATTTTAGTTTGATGCATATCCAATCAGTGTTCAAATTTAAATGG
TCTAAAATATTTTAAAAATCAGATTGCTTGAATCAAAATTCAGATCTACCACTTAGTACAGTTTATATTGTGATATGTCCTTGAGT
ATAATCTATGGACACCCCCTCAACTCTTGCAATTTATTTAAGTAAGTTGAAACATTTAGTCACTAGAGATTTCCACGTACTAGATT
TTGCTGATTTCATTTATTTGGTATAGTTTAATGTATTTTCTGTAAATTGGTAGAGTCAAAAAGAAATAGAGCGTGGGCCTAGTTGG
AAAGACAGATTTCATTCAGTACTATTGCAATAGGGGAAAATAGAACCAAGTTCCATTTCAGAATACAACAAAGACACTTGGGGATG
AAGCAGAGTGAGAGGGTCAATGGATGGAACATTTCTAAAAGGAGACATCAAAGGTAGAAGGTTTCTTTCTGACCTGACTTAGGATT
CCTGCTAAAGGCAGGCCAAGGTGATCATAGATCCAGAGTGGGAGATAGTTTAGGAGGATTCTTACTATATATAACTGAGCTAAACA
GACTGATGACGGGGCTCAAGGACAAATACTAGTTGATTGCTCAGAGCAGCCTGCTTAAAAGTATGGTCAAGGAGAGAATCTTTAGT
GTAGAATGGTGATCAGATTTAAGTTTGTTGTCCTTTGGTTCTTGTTTTCTTTCTGAAAAGCAAGACCTGCTTCAAAGGTGGTGGTG
TGCTCTCTTGCACTAGGAGGTATATTATGTCTTGTATTCAGGCTATTTCAGTTCATTTCAGATTACACAGTTTTATGTAACTGCTTTAAC
TTTGTGTTTGTACTGAATATTAGTTCTTGATGGCAGAGAACATATTTCACTTTCAGAATGTTTTTCTGCTTACATGGATTTATTT
TCAAGAAATTTCATACAATACTTTATTTAGAAGAAAGCAGAATTTTCTGAAATCACAGTATGCAGAGGCATTTACCATCAACTCTG
ACAAACATCCTTCTGGTCCCTTTTCTATGCATGTATTCTGTGGAATTGGATGCAAACACATATTAAAAATATATACATTTGCCTAA
TGGAACCACAGCATACAGATGATTTTATAGTCTGCTTTTCCATTCAGTGATATTCCAGGAAAATATTTTCTTATCAGTGTGTTTAG
ATACACATCCTTTCAATAGGTCATCATTTAAATTTCTACTGTCTAACATTATTTTAAAAGTAAGTTTTTCTCTAATAATCAGCACC
ACATTAAACATACTGTGTAGCTTTCACTTTAAAATTATTTTTATGGACATTTGATATCATTAGCTTGACATTATTAATAACAGTTA
CCTTGACTTTTTGATATCATCTGTACTGTCTTGGAAAGTGAAAATATTTGTCAAACTGTTAAATGATAAGAAAGAATAATTATACA
CTGCCAAGCAGAATTTCCTTCTTTTGCTCCCTCCCCACCTTCTGCTCCAATCACATAAATAAGAGCTGTTTTTTCTTTGCAGTATG
CATTGCCTCAGGAACAAAGGTGGCTCTGTTTAATCGACTACGATCCCAGACAGTTAGTACCAGATACTTGCATGTAGAAGGAGGTA
ATTTTCATGCCAGTTCACAGCAGTGGGGAGCCTTTTTTATTCATCTCTTGGATGATGATGAATCAGAAGGAGAAGAATTCACAGTC
CGAGATGGCTACATCCATTATGGACAAACAGTCAAACTTGTGTGCTCAGTTACTGGCATGGCACTCCCAAGATTGATAATTAGGAA
AGTTGATAAGCAGACCGCATTATTGGATGCAGATGATCCTGTGTCACAACTCCATAAATGTGCATTTTACCTTAAGGATACAGAAA
GAATGTATTTGTGCCTTTCTCAAGAAAGAATAATTCAATTTCAGGCCACTCCATGTCCAAAAGAACCAAATAAAGAGATGATAAAT
GATGGCGCTTCCTGGACAATCATTAGCACAGATAAGTTGAATGGCGGTGGGGACGTAGCAATGCTTGAACTTACAGGACAGAATTT
CACTCCAAATTTACGAGTGTGGTTTGGGGATGTAGAAGCTGAAACTATGTACAGGTGTGGAGAGAGTATGCTCTGTGTCGTCCCAG
ACATTTCTGCATTCCGAGAAGGTTGGAGATGGGTCCGGCAACCAGTCCAGGTTCCAGTAACTTTGGTCCGAAATGATGGAATCATT
TATTCCACCAGCCTTACCTTTACCTACACACCAGAACCAGGGCCGCGGCCACATTGCAGCAGGAGCAATCCTTCGAGCCAA
TTCAAGCCAGGTGCCCCCTAACGAATCAAACACAAACAGCGAGGGAAGTTACACAAACGCCAGCACAAATTCAACCAGTGTCACAT
CATCTACAGCCACAGTGGTATCCTAACTACCGTCTTTTTGCTAGGACTTAAACTGACTTGAGTGTGGCAAAAAGTTAACAAAAAG
GAGAAAAAATGAACAATCGTTTGTGGTTTCTTGGGAAAACTTTTCATACCAGGTGATACTATTCAAAAACCCCGTTGTCTCCCTGC
AAGTGCTGATTTGAAATGCAGAAGCCACAGT

81  CAGACAAGGACAGAAAGGGGGCTGGAGGAGAAAGAGAGAGAGAGATACAGAGAGAGAGAGAGAGAGAGAGAGAGAGAGAGAG
AGATCAGCCCTGGTGAGGGAGGAAAACTCCATAGATAATACAGGGAGCTCCTGCAGGAAGACTCAGGGAGAAGATCCCAGAACTTA
CCCTAAGACTGTTGAGAGAGTAGGGGGTAGCTTTGCAGGACCTGGTTTGGGGGTCATCAAGCAGTAACGGTTACTGCACAGGCGTT
GCCACTGAGCCAGAGCCATTTAACCCGACCTGTGTGGCTGGGGATCAAGCTTCAGATACCCCATAACTCTGACTCTCAGACTGTTT
TGGGGGCCCCGTGGCTGCAGACAAGGGAAGGAGGGGCACGTGAGGGCTGGGTCCCTGCCTCCCCCGTCCTCCGCTGTCACTCACT
ACCCCAACAGTCGCCCAGGGGGCGGGCCCCGGAGAGGTGGGGATGGGGAGGGTAATCTTGGCAGGCGCCTGCTGCATGGCGTAGG
TAGGGACTATTGAGGGGGGCGGACGCCGAGGGGGTGAACACGAGTGGGAAGCTAAGAGAGACACGGGGAGGGGGGACCGGGA
ACCATTTGAATGAGAGGAGGGGATCACGGGTAGAGTGGGCTCCAGGAGGTAGGGCGAGCAGGGTGTGACGGGGGCCAGACTCTTGA
GCCAGGTAAGGGGAGCAGTACATATCCAGCCATACTCATGGACCCCAGTGATTTCCCAGTCCATTTGACCCATTGACCCTGCCAG
AGAAGCCCCTGGCTGGAGACCTACCAGTAGACATGGAATTTGGAGAGGATCTACTGGAATCCCAGACTGCCCCAACTCGAGGATGG
GCCCCCCCTGGCCCTTCTCCATCCTCGGGAGCCCTGGACCTGCTTGATACCCCTGCTGGCCTGGAAAAAGACCCTGGAGTCCTGGA
TGGAGCCCACTGAGTTGCTGGGGCTGGGGGGGCTGCTCTATAAAGCCCCCTCTCCCCCGGAGGTGGACCACGGTCCTGAGGGAACCC
TGGCATGGGATGCAGGAGATCAGACCCTAGAGCCTGGACCAGGGGGCCAGACCCCTGAGGTGGTACCACCTGATCCAGGGGCTGGG
GCAAATTCCTGTTCACCTGAGGGGCTACTAGAGCCTTTGGCTCCAGATTCTCCAATAACACTGCAGTCCCACATATTGAAGAGGA
GGAGACCACCTCCATAGCTACTGCAAGAAGGGGCTCCCCTGGGCAGGAGGAGGAGCTTCCCCAAGGGCAGCCACAGAGCCCAAATG
CCCCGCCTAGCCCTTCAGTGGGAGAGACTCTGGGGGATGGAATCAACAGTTCTCAGACCAAACCTGGGGGCTCTAGCCCCCTGCA
CATCCTTCCTTGCCAGGAGATGGCCTGACTGCGAAGGCGAGTGAGAAGCCGCCTGAACGGAAGAAGAGCGAGCGCGTTAGGAGAGC
AGAACCTCCAAAACCTGAGGTTGTAGATTCCACTGAGAGCATTCCAGTGTCAGATGAGGATTCTGATGCCATGGTAGATGACCCCA
ATGATGAGGACTTTGTGCCATTCCGGCCCCGGCGCTCTCCTCGCATGTCCCTACGCTCAAGTGTGTCACAAAGGGCCGGGCGCTCT
GCAGTGGGCACCAAGATGACTTGTGCACATTGCCGGACACGCTCGAGAAGGGGCAGCTGCCTATCAGCGACAAGGGCTGCCTCA
GCTCTTCTGCTCGTCATCCTGCCTCACCACTTTCTCCAAGAAGCCCTCGGGCAAAAAGACCTGTACCTTCTGCAAGAAGGAGATCT
GGAACACCAAGGACTCGGTTGTGGCGCAGACTGGTTCTGGAGGCTCCTTCCATGAGTTCTGCACATCCGTCTGTCTCTCCCTGTAT
GAGGCCCAGCAGCAGCGCCCGATCCCCCAGTCTGGGGATCCCGCCGACGCTACTCGCTGCAGCATATGCCAGAAGACTGGAGAGGT
CCTGCACGAGGTCAGCAATGGCAGCGTGGTACACCGGCTTCTGCAGCGATTCTTGCTTCTCCAAATTCCGGGCCAACAAGGGATCA
AAACCAACTGTTGTGACCAGTGTGGGGCTTACATCTACACCAAGACCGGGAGTCCTGGCCCTGAGCTCCTCTTCCACGAGGGCCAA
CAAAAGCGGTTCTGCAACACAACCTGCTTGGGGCGCTACAAGAAGAAAACACACGTGTGTACCCATGTGTCTGGTGCAAGACCCT
GTGTAAGAACTTTGAGATGCTATCACATGTGGATCGTAATGGCAAGACCAGCTTGTTCTGTTCCCTGTGCTGTACCACTTCTTACA
AAGTGAAGCAGGCAGGGCTCACTGGCCCTCCCCGACCCTGCAGCTTCTGCCGCCGCAGCCTCTCTGACCCCTGTTACTACAACAAG
GTTGACCGCACAGTCTACCAGTTCTGCAGCCCCCAGCTGCTGGACCAAGTTCCAGCGCACAAGCCCTGAGGGGGGCATTCACCTGAG

TABLE 1-continued

Sequences Table. First column: SEQ ID No. Second column: corresponding mRNA sequence. For the 3 different groups, see explanation in the text.

```
   CTGTCACTACTGTCACAGCCTCTTCAGTGGCAAGCCTGAGGTCTTGGACTGGCAGGACCAAGTGTTCCAGTTCTGCTGCCGTGATT
   GCTGTGAGGACTTCAAGCGGCTTCGGGGTGTGGTGTCCCAGTGTGAGCACTGTCGGCAGGAGAAACTCTTGCATGAGAAACTCCGA
   TTCAGCGGAGTGGAGAAAAGCTTCTGCAGCGAAGGCTGTGTGCTGCTGTACAAACAGGACTTCACTAAGAAGCTGGGCTTGTGCTG
   TATCCACTTGTACTTACTGCTCCCAGACCTGCCAGCGCGGAGTCACCGAGCAACTGGATGGCAGCACCTGGGACTTCTGCAGTGAGG
   ACTGTAAGAGCAAGTACCTGCTGTGGTACTGCAAGGCTGCCCGGTGCCATGCTGTAAGCGCCAGGGGAAGCTGCTGGAGACCATC
   CACTGGCGTGGGCAGATCCGTCATTTCTGCAACCAGCAGTGTCTTCTGCGTTTCTATAGCCAGCAGAACCAACCCAACCTGGATAC
   CCAGAGTGGGCCCGAGAGCCTCCTGAACAGTCAGTCTCCTGAGTCAAAACCCCAGACACCCTCTCAAACCAAAGTGGAGAACAGCA
   ACACAATCCCTGTGAAGACCCGATCAGCTCCCACTGCTCCCACCCCTCCACCCCCACCACCCCCAGCAACACCCCGCAAAAACAAG
   GCTGCCATGTGTAAGCCACTGATGCAGAATCGGGGCGTCTCCTGCAAGGTGGAGATGAAGTCCAAAGGAAGTCAAACAGAAGAGTG
   GAAGCCACAGGTGATCGTGCTGCCCATCCCAGTGCCCATCTTCGTGCCAGTGCCTATGCATCTGTACTGCCAGAAAGTCCCGGTGC
   CTTTCTCGATGCCTATCCCGGTGCCTGTGCCCATGTTCTTGCCCACTACCTTGGAGAGCACAGACAAGATTGTAGAGACCATTGAG
   GAGCTGAAGGTGAAGATCCCTTCCAACCCCTTGGAGGCCGACATCCTGGCTATGGCAGAAATGATTGCAGAGGCTGAGGAGTTAGA
   CAAGGCCTCATCTGACCTTTGTGATCTTGTGAGCAACCAGAGGCTGCAGAGGGACTCCTGGAAGACTGTGACCTGTTTGGGCCTGCTC
   GAGATGATGTCCTGGCCATGGCAGTCAAGATGGCCAATGTCTTGGATGAGCCTGGGCAAGACTTGGAGGCAGACTTCCCTAAGAAT
   CCTCTGGACATTAATCCCAGTGTAGACTTCCTCTTTGATTGTGGCCTGGTAGGGCCTGAGGATGTGTCTACTGAACAAGACCTTCC
   CCGAACCATGAGGAAGGGTCAAAAGCGGCTGGTGCTTTCCGAAAGCTGCTCCCGGGACTCCATGAGCAGTCAGCCTAGTTGTACCG
   GGCTCAACTATTCATATGGTGTCAATGCTTGGAAGTGCTGGGTGCAGTCTCAAAATATGCCAATGGAGAAACCAGCAAGGGTGATGAG
   CTGCGCTTTGGCCCCAAACCCATGCGTATCAAAGAGGATATTCTCGCCTGCTCAGCTGCTGAGCTCAACTACGGTCTGGCCCAGTT
   TGTGAGAGAAATCACTCGGCCCAATGGTGAACGATATGAACCTGACAGTATCTACTATTTGTGTCTTGGCATCCAGCAGTACTTGC
   TGGAAAATAACCGGATGGTGAACATTTTCACGGACCTTTACTACCTGACTTTTGTTCAAGAACTCAACAAGTCTCTGAGTACCTGG
   CAGCCCACACTCCTCCCCAACAATACGGTGTTCTCTCGAGTGGCAGGAGGAGCACCTCTGGGAGTGTAAGCAACTGGGGGTCTACTC
   GCCCTTTGTCCTCCTCAACACCCTCATGTTCTTCAACACTAAGTTTTTTGGGCTGCAGACAGCTGAGGAACACATGCAACTCTCCT
   TCACCAATGTGGTGCGGCAGTCCCGCAAGTGTACCACCCCTCGGGGCACCACCAAGGTGGTGAGCATCCGCTACTATGCCCAGTC
   CGCCAGAGGAAAGGGCGAGACACGGGTCCTGGAAAACGGAAGAGAGAAGATGAAGCCCCTATCTTAGAGCAGCGTGAGAACCGCAT
   GAATCCCCTCCGCTGCCCTGTCAAGTTCTATGAATTCTATCTCTCAAAATGTCCTGAAAGCCTCCGGACTCGCAACGATGTGTTCT
   ACCTGCAACCTGAACGGTCCTGCATCGCCGAGTCACCTCTCTGGTATTCTGTGATCCCCATGGACCGCAGCATGTTGGAGAGCATG
   CTCAATCGCATCCTGGCTGTGCGCGAGATTTATGAGGAACTGGGTCGTCCTGGGGAGGAAGACCTGGACTGAGCTCGTGTGCCATC
   CATATCCATCTTTCACATCAATGTCTGTCCTGTGGCCATGTCCCTCAGGGTGACAGGCCCAGGAACCAATGCTACTCATTCTGAAG
   GGCCCTGACTGCTCCTTTCCGCTCACCCATTCCCTGCCTTCTCTAGGAACCCTGGCTTTTATCTTCTTCCGTACCACTTGACAACC
   ATGGGGCCCTGGTCTTCTGTACTCAGGGGCTGGTCTCCCAGTGATGGGCAAAAGCCAGCTTGCCCGTTTTCTTTATGCTTCAGAGT
   AAACCCCTCCTTCTGGGTCCAGACTCTGGGTGGAGTGTTAATAGCTCTGGTGATCCTGTTGGCTTTGGGTTTCCTGACCCATCCCG
   CATAGGTAGAGCCTCTTGTTCCTAGGCATGACCTAGGGAAAAACCCAGCTGCCTTCTCTGCCCTGTGCCCACTCCCTTCTCTACTC
   TTCCCAGCACCATGCCAAAAGGTCTTATCTGAAAGGTAAGAAATAAACAATGAAAGCGATGAGGGGACCATTTACATAAAACACA
   GAGCTTAGACACTCTTCCCCTCCTATGAAATAATTGGTTGTTGGCACCATCTCACCACCGCATATCCCTCCACCCCCTGGCAAGCAC
   CAATCCTTGGTGCTGCCGTTTTTAAAATCTTCCAAATGCCTTTTTTCCTCAGAGGCAGAGAATGACTAAGTACGGGGAGCAGACT
   CCTGTTGTGCAGACTCCTGTCCCCTTGGTTTCTGTGTTTGTCTCTCTGCCATCTTAGGTTGCCATGAGCCATGGTGTCAACATGCT
   TAGCCCCCTCTGTAACTGCCTCCCTTTAGTTCAATGGACAGACCTCCCAAGGCAAAACTACCTTCTGACTTGGGTTAGAGGCTGG
   GTTCCCCTCTATTGTTCCCCTATCATAAGAGCTAGGCCAAGCCTATCAGGGACCTTGAGTCATGCAGGATGGGATCTGTGGTCAAGG
   ACAGGCGAGGAGCTGTGGGCGCAGGGCCTGCCGCCACTGCCTACATCTTCTCTCTTCCCCATCTTGCATTGGAGGTCCCAGAAAAC
   AATTAGCTTCTGGCAAAGGGGGTACCCACTTCTTTCCCTGTTGACTTTGCTGTTTCCCAGGCTCCTTTTTGTGTTTTTATAACTGT
   CACCAGTTAGCCACTGTTTAAATTGTATATATTGTTCTGAGGCGCCTGGCCTGTCCCTTCAGTGAGCCATGCCCACCCTTGTGTTG
   TAGTGAGAAGCTGTTGTCACGACTAACCTTCTGTCTCTGAAATTGTTTGTTTCAAATAAAGAGTTAAAATTGAAAAAAAAAAAAAA
   AAAAAAATAAAAAAAAAA

82 CAGCAGAGACGACGCCTGCAGCAAGGAGACCAGGAAGGGGTGAGACAAGGAAGAGGATGTCTGAGCTGGAGAAGGCCATGGTGGCC
   CTCATCGACGTTTTCCACCAATATTCTGGAAGGGAGGGAGACAAGCACAAGCTGAAGAAATCCGACTCAAGGAGCTCATCAACAA
   TGAGCTTTCCCATTTCTTAGAGGAAATCAAAGAGCAGGAGGTTGTGGACAAAGTCATGGAAACACTGGACAATGATGGAGACGGCTG
   AATGTGACTTCCAGGAATTCATGGCCTTTGTTGCCATGGTTACTACTGCCTGCCACGAGTTCTTTGAACATGAGTGAGATTAGAA
   GCAGACAAACCTTTCCTGTAACAGAGACGGTCATGCAAGAAAGCAGACAGCAAGGGCTTGCAGCCTAGTAGGAGCTGAGCTTTCCA
   GCCGTGTTGTAGCTAATTAGGAAGCTTGATTTGCTTTGTGATTGAAAAATTGAAAACCTCTTTCCAAAGGCTGTTTTAACGGCCTG
   CATCATTCTTTCTGCTATATTAGGCCTGTGTGTAAGCTGACTGGCCCCAGGGACTCTTGTTAACAGTAACTTAGGAGTCAGGTCTC
   AGTGATAAAGCGTGCACCCGTGCAGCCCCGCCATGGCCGTGTAGACCCTAACCGGAGGGAAACCCTGACTACCGAAAATTACCCC
   CGGGGGCACCCCTTAAAAACCTTCCCACTACCCTTTTAAAAAACACAAGCCCTTTATCCCAGCCATTTATTTTTAAAAAAAAAAAA
   AAAAAAAAAGGGCCGGGCCGCCTTCCTAAGAAGGTATTCCCCCCTCCCGAAGGGGGGGCCCCCAAAAGCTTTTAACGGCGGTT
   AACCCCAAGCCTTTTTCCTTTGTAACAAAAAAGGGGGGCTCCCCTAATAAGATGGAAAACTCGCCATTTTATATAAGGCTTTAGG
   GCCCACCTTGGCCCCGCTCCGGTNTTTTACCAAAACAGGTACCCCGGACATTGTGGGAAAAAAAATTTGCCTTAAACTCTGGGGGG
   AAATCTTTTTTGTGGGAAAGAGAAAAACCCCTTTACACTCTTCCCTGGGGGGGGGGGGGAACACCTTAAAATTTGGGGAACACA
   AAACTTTCACCTTTTTTCGGGAGGAGTTTTTTTAAAAGGGCCTTCTCAAAGGGGGGGTTAAATTATTTTCAAACCCTTCTTTTTTT
   ACAGAGGGGGGAAATACA

83 TTTCGACTCGCGCTCCGGCTGCTGTCACTTGGCTCTCTGGCTGGAGCTTGAGGACGCAAGGAGGGTTTGTCACTGGCAGACTCGAG
   ACTGTAGGCACTGCCATGGCCCCTGTGCTCAGTAAGGACTCGGCGGACATCGAGAGTATCCTGGCTTTAAATCCTCGAACACAAAC
   TCATGCAACTCTGTGTTCCACTTCGGCCAAGAAATTAGACAGAAACATTGGAAAAGAAATCCTGATAAGAACTGCTTTAATTGTG
   AGAAGCTGGAGAATAATTTTGATGACATCAAGCACACGACTCTTGGTGAGCGAGGAGCTCTCCGAGAAGCAATGAGATGCCTGAAA
   TGTGCAGATGCCCCGTGTCAGAAGAGCTGTCCAACTAATCTTGATATTAAATCATTCATCACAAGTATTGCAAACAAGAACTATTA
   TGGAGCTGCTAAGATGATATTTTCTGACAACCCACTTGGTCTGACTTGTGGAATGGTATGTCCAACCTCTGATCTTTGTGTAGGTG
   GATGCAATTTATATGCCATGCAGTGGGACCCATTAATATTGGTGATTGCAGCAATTTGCTACTGAGGTATTCAAAGCAATGAGT
   ATCCCACAGATCAGAAATCCTTCGCTGCCTCCCCCAGAAAAAATGTCTGAAGCCTATTCTGCAAAGATTGCTCTTTTTGGTGCTGG
   GCCTGCAAGTATAAGTTGTGCTTCCTTTTGGCTCGATTGGGGTACTCTGACATCACTATATTTGAAAAACAAGAATATGTTGGTG
   GTTTAAGTACTTCTGAAATTCCTCAGTTCCGGCTGCCGTATGATGTAGTGAATTTTGAGATTGAGCTAATGAAGGACCTTGGTGTA
   AAGATAATTTGCGTGAAAAGCCTTTCAGTGAATGAAAAGCTCTTAGCACTTTTGAAAGAAAAGCTACAAAGCTGCTTTCATTGG
   AATAGGTTTGCCAGAACCCAATAAAGATGCCATCTTCCAAGGCCTGACGCAGGACAGGGGTTTTATACATCCAAAGACTTTTTGC
   CACTTGTAGCCAAAGGCAGTAAAGCAGGAATGTGCGCCTGTCACTCTCATTGCCATCGATACGGGGAGTCGTGATTGTACTTGGA
   GCTGGAGACACTGCCTTTGACTGTGCAACATCTGCTCTACGTTGTGGAGCTCGCCGTGTGTTCATCGTCTTCAGAAAAGGCTTTGT
   TAATATAAGAGCTGTCCCTGAGGAGATGGAACTTGCTAAGGAAGAAAAGTGTGAATTTCTGCCATTCCTGTCCCCACGGAAGGTTA
   TAGTAAAAGGTGGGAGAATTGTTGCTATGCAGTTTGTTCGGACAGAGCAAGATGAAACTGGAAAATGGAATGAAGATGAAGATCAG
```

TABLE 1-continued

Sequences Table. First column: SEQ ID No. Second column: corresponding mRNA sequence. For the 3 different groups, see explanation in the text.

|   |   |
|---|---|
|   | ATGGTCCATCTGAAAGCCGATGTGGTCATCAGTGCCTTTGGTTCAGTTCTGAGTGATCCTAAAGTAAAAGAAGCCTTGAGCCCTAT |
|   | AAAATTTAACAGATGGGGTCTCCCAGAAGTAGATCCAGAAACTATGCAAACTAGTGAAGCATGGGTATTTGCAGGTGGTGATGTCG |
|   | TTGGTTTGGCTAACACTACAGTGGAATCGGTGAATGATGGAAAGCAAGCTTCTTGGTACATTCACAAATACGTACAGTCACAATAT |
|   | GGAGCTTCCGTTTCTGCCAAGCCTGAACTACCCCTCTTTTTACACTCCTATTGATCTGGTGGACATTAGTGTAGAAATGGCCGGATT |
|   | GAAGTTTATAAATCCTTTTGGTCTTGCTAGCGCAACTCCAGCCACCAGCACATCAATGATTCGAAGAGCTTTTGAAGCTGGATGGG |
|   | GTTTTGCCCTCACCAAAACTTTCTCTCTTGATAAGGACATTGTGACAAATGTTTCCCCCAGAATCATCCGGGGAACCACCTCTGGC |
|   | CCCATGTATGGCCCTGGACAAAGCTCCTTTCTGAATATTGAGCTCATCAGTGAGAAAACGGCTGCATATTGGTGTCAAAGTGTCAC |
|   | TGAACTAAAGGCTGACTTTCCAGACAACATTGTGATTGCTAGCATTATGTGCAGTTACAATAAAAATGACTGGACGGAACTTGCCA |
|   | AGAAGTCTGAGGATTCTGGAGCAGATGCCCTGGAGTTAAATTTATCATGTCCACATGGCATGGGAGAAAAGAGGAATGGGCCTGGCC |
|   | TGTGGGCAGGATCCAGAGCTGGTGCGGAACATCTGCCGCTGGGTTAGGCAAGCTGTTCAGATTCCTTTTTTTGCCAAGCTGACCCC |
|   | AAATGTCACTGATATTGTGAGCATCGCAAGAGCTGCAAAGGAAGGTGGTGCCAATGGCGTTACAGCCACCAACACTGTCTCAGGTC |
|   | TGATGGGATTAAAATCTGATGGCACACCTTGGCCAGCAGTGGGGATTGCAAAGCGAACTACATATGGAGGAGTGTCTGGGACAGCA |
|   | ATCAGACCTATTGCTTTGAGAGCTGTGACCTCCATTGCTCGTGCTCTGCCTGGATTTCCCATTTTGGCTACTGGTGGAATTGACTC |
|   | TGCTGAAAGTGGTCTTCAGTTTCTCCATAGTGGTGCTTCCGTCCTCCAGGTATGCAGTGCCATTCAGAATCAGGATTTCACTGTGA |
|   | TCGAAGACTACTGCACTGGCCTCAAAGCCCTGCTTTATCTGAAAAGCATTGAAGAACTACAAGACTGGGATGGACAGAGTCCAGCT |
|   | ACTGTGAGTCACCAGAAAGGGAAACCAGTTCCACGTATAGCTGAACTCATGGACAAGAAACTGCCAAGTTTTGGACCTTATCTGGA |
|   | ACAGCGCAAGAAAATCATAGCAGAAAACAAGATTAGACTGAAAGACAAAAATGTAGCTTTTTCACCACTTAAGAGAAACTGTTTTA |
|   | TCCCCAAAAGGCCTATTCCTACCATCAAGGATGTAATAGGAAAAGCACTGCAGTACCTTGGAACATTTGGTGAATTGAGCAACGTA |
|   | GAGCAAGTTGTGGCTATGATTGATGAAGAAATGTGTATCAACTGTGGTAAATGCTACATGACCTGTAATGATTCTGGCTACCAGGC |
|   | TATACAGTTTGATCCAGAAACCCACCTGCCCACCATAACCGACACTTGTACAGGCTGTACTCTGTGTCTCAGTGTTTGCCCTATTG |
|   | TCGACTGCATCAAAATGGTTTCCAGGACAACACCTTATGACCAAGAGAGGCGTACCTTATCTGTGAATCCGGTGTGTTAAGGT |
|   | GATTTGTGAAACAGTTGCTGTGAACTTTCATGTCACCTACATATGCTGATCTTTTAAAATCATGATCCTTGTGTTCAGCTCTTTCC |
|   | AAATTAAAACAAATATACATTTTCTAAATAAAAATATGTAATTTCAAAATACATTTGTAAGTGTAAAAAATGTCTCATGTCAATGA |
|   | CCATTCAATTAGTGGTCATAAAATAGAATAATTCTTTTCTGAGGATAGTAGTTAAATAACTGTGTGGCAGTTAATTGGATGTTCAC |
|   | TGCCAGTTGTCTTATGTGAAAAATTAACTTTTTTGTGGCAATTAGTGACAGTTTCCAAATTGCCCTATGCTGTGCTCCATATTT |
|   | GATTTCTAATTGTAAGTGAAATTAAGCATTTTGAAACAAAGTACTCTTTAACATACAAGAAAATGTATCCAAGGAAACATTTTATC |
|   | ATTAAAAATTACCTTTAATTTTAATGCTGTTTCTAAGAAAATGTAGTTAGCTCCATAAAGTACAAATGAAGAAAGTCAAAAAATTA |
|   | TTTGCTATGGCAGGATAAGAAAGCCTAAAATTGAGTTTGTAGAACTTTATTAAGTAAAATCCCCTTCGCTGAAATTGCTTATTTTT |
|   | GGTGTTGGATAGAGGATAGGGAGAATATTTACTAACTAAATACCATTCACTGCATCATGCGTGAGATGGGTGTACAAACTCATCCTC |
|   | TTTTAATGGCATTTCTCTTTAAACTATGTTCCTAACAAAATGAGATGATAGGATAGATCCTGGTTACCACTCTTTTGCTGTGCACA |
|   | TACGGGCTCTGACTGGTTTTAATAGTCACCTTCATGATTATAGCAACTAATGTTTGAACAAAGCTCAAAGTATGCAATGCTTCATT |
|   | ATTCAAGAATGAAAAATATAATGTTGATAATATATATTAAGTGTGCCAAATCAGTTTGACTACTCTCTGTTTTAGTGTTTATGTTT |
|   | AAAAGAAATATATTTTTTGTTATTATTAGATAATATTTTTGTATTTCTCTATTTTCATAATCAGTAAATAGTGTCATATAAACTCA |
|   | TTTATCTCCTCTTCATGGCATCTTCAATATGAATCTATAAGTAGTAAATCAGAAAGTAACAATCTATGCTTATTTCTATGACAAA |
|   | TTCAAGACGTAGAAAAATAAAATGTTTCATTATGCACTTTTAGAAATGCATATTTGCCACAAAACCTGTATTACTGAATAATATCA |
|   | AATAAAATATCATAAAGCATTTT |
| 84 | AATTGTAAGGACTCTGCATTGCTCCATTTCTTTTTAAAAATTTTTCTTCAAGAAGGATTATATATTGCTCATTTCTGTCTCCACCC |
|   | CAGAAGTCAGCCTTTTCTGAGGTCCAGTCCTTGCACCTCTGTTCTCTCCCACCCTCACTTCCTCGCCCCTTTTCCCTAGAAATCC |
|   | CCTTACTTGGACAGCTTTGCCTCTTACCTGCATTTTAATCCTTGCAGCCTCCTAAGCATCGGTTCCCTTTGATGAACAGCACTCAC |
|   | CTTAAACTCAAAAAGCAAACCAGTCCTCTTCCCACTCCAACTGTCCCTTTTCTCCCTTCTTGTCTCCCTTATATCACCTTTCTCCA |
|   | AGTGATTCAGGTCTTAACCTTGGAACCCTTTTCTCCTTCCTCTTCCATCCAGGTCCCTGGGTTCTGTCCATTTCGCCCTAGGCTC |
|   | TGTCATCCTCTCTTCCCCTGGCCACTCTGCTCCATGCTCTCACGGCCTTGGCGTGAACTTGGGATAAGATGTAAATTCCCAGACT |
|   | CACAATTCCTGATCTTTTCTCAGCTGATTGCCCCTCACAAAGATGTGTTTGTCGTTTTTCAGCTGTTTAATCTCTGTCCGTCTC |
|   | ATGAGACCCCCTCCAACCTCATTTCCTTTGAGAAGCCTTCTCTGACAGCTGAAGCCAATGGCAAACACTTTGCCTCTTGAATTGTG |
|   | CCAGCATTTATGGTCTACACCAGAAGTCGCAAACAGCCATATCTCATTAAAAATTGTAAAAGTTGGTTGTCATCATGTGAAAACC |
|   | AGATGGTTTGATGTAACAATTCTGATTTCTGGCTTCTCCTGAAAGTTGAGAACATCTGGCAACACTGGCTTTGCTTTCCCACGTGG |
|   | CAGTGTTGGTTTGGTGCAGAGGAGTGGTTATCGCCTGTCGGACAGATCGTGCACTCCCAGCAGGATTTGTGCCCCTGTGCTACCTAT |
|   | CCGACTCCTCTGGACAATTGCATTTGCAACCCTTGTCTATACCATCGATCTGCCATGACTTAGCAAATATGTCTTGTCTTGTTATT |
|   | GACTGTTCTGTGTTTACATGTGTGTCTTATATTCCCTTCACAATTCAATTGCCCTCTTCCTGAGGGTAGGGAGTCTCTGTTAACTT |
|   | TACATGCCTCCTGCAGTACCTGACACATAGTAGGTCTGTTGTTTGAGAGGCCAGTGCCTGAGGTGGAATTTGCCTTATGACTTGCT |
|   | TCTAGGTCAGTGGTTCTCACTTGCACCCTCTGTCAACATTATACCAGGCTTGGGGGTGGGGTACACTCTGTCCAGTGTTTACTAGA |
|   | AAGTTCCAGCAGAGGTTTGAAGCATGCCCACCCCTTAGCATTACAGGGTTGGGCTTGTGGTGAAGGCAATGGCGGGTGTCATTTGC |
|   | AGAACCCCCCTGGGTGATTCCAGGGCATCCCCTAGTGGAAGGCTCACGTGGCCATTTTCAGCCTGTGTTGTAACTTATTGCTTTAG |
|   | ATAAAAGGGACAAAGTATTTCAGGTAAGATTTGACCTCTGGGAAGGTCCAGACCCCCAGATGCGTTTTCTATTGGAAATTCCCCAG |
|   | CTGGGGCCGGGCCAGAGACGAGGAGGGCTCCCCACAATTCTGAGAGTGGCTGGTGGCCTGCACCTCATTTTTGTCCCCCACCTTCC |
|   | TTTCCCTCACCCCTTTCTTCAGTCTTTACCTCTTGCTCTTTCCATCCATTTTTACCTTTCCACAAGCTCTCGGTTCTATGGATTTG |
|   | TGGGATTTTATTTTTCTTCCTTCCCCATGTGCAAATCTACCCCTGCTGTGACATGGAGAAGGTTGAAGAGGACACACCAGAGTAC |
|   | ATACTGCCTTCTTCCAACCCAGCTTTCTAACAGCAGAGCTGCTGAGGGACCAATGGCCAGTAAAGGTGCAGAGAAGGACATGAACC |
|   | CTTCCTGTTGTTGGAAAGATTTAAGTGTTTCTCCCTGGAGCAGTTTTCACAACTGGTTTGCCCTCCTTTGCTTCTGCGAGCTGCTC |
|   | AGATAGCACTAGATCTCTGCAGCTTGCACAGGCAGGCCAAATTCAACCAGATACTTCTTATTCTAATTCATATGTCCGTTCTCTAA |
|   | ATTCTTCTTTCTATTTTACTGCTTCATTGTATTTGTGCTAAGCTGCCTCATAACCTGAAGATAATCTAAAATATGGCTTTCCTGCC |
|   | ATCAGCATAGCCTTCAGCTGCTTTAGGGCTGCAGATGTGGTGCAGGTGCAGCGTGCCACTGCAGCTTCTGGGAACTGTTTGGGGATGCCAT |
|   | GTTCTGAAGCACTGCATGCCGCGGAGATGTCGCATCTGATGGAGAGTAACTGCAACGTGGAGAGTTCACGTGGCCATCTCCAGTC |
|   | TTGTATGACAGATGCTTAACTTGTGTTTGAAATTTTCAGAGATCATTTCCATTTTTGCATAGCAAAGAATCTATTCTTGTCCTCT |
|   | AGCTAGAAGGCTTTGCATGGCTAGAATAAATTTCTTTTCAACGAAACGGTATGCTCTGGCAAATCTTCCTTTGGTTCAAGGCAGCC |
|   | CACTAAACCCGCTGGCGTGCTGCTTTGATGAAGTGTGGTGCAGGTGCAGCGTGCCACTGCAGCTTCTGGGCAGCCTGAGTTGGTGCCAT |
|   | CTAGGTACGCTCAGGCTTCTGTTCCACAAGTAACGCCCCAGCCTGGTCCATAGTTTGCTGCTCCAGTAGATGGCAAATAACAAAA |
|   | GCAAATAGAACAGATGTATCCCCTCTTGCACAGCCTCACCTACCAGTCGGCTAGAAAAGCCCATTGGGTAGTTGGGGAGAAATAG |
|   | CTTGGTAATGCCGTGAGTTTGTTGGGTGTCTAACTGAACAATTTGCTGCTCTAGATAAGTGGGCGGAAAAACCAGCCTTTGGGACT |
|   | CCCCTAGAAGAACACCTGAAGAGGACGGGCGCGAGATTGCGCTGCCCATTGAAGCCTGTGTCATGCTGCTTCTGGAGACAGGCAT |
|   | GAAGGAGGAGGGCCTTTTCCGAATTGGGCTGGGGCCTCCAAGTTAAAGAAGCTGAAAGCTGCTTTGGACTGTTCTACTTCTCACC |
|   | TGGATGAGTTCTATTCAGACCCCATGCTGTAGCAGGTGCTTTAAAATCCTATTTACGGGAATTGCCTGAACCTTTGATGACTTTT |
|   | AATCTGTATGAAGAATGGACACAAGTTGCAAGTGTGCAGGATCAAGACAAAAAACTTCAAGACTTGTGGAGAACATGTCAGAAGTT |
|   | GCCACCACAAAATTTTGTTAACTTTAGATATTTGATCAAGTTCCTTGCAAAGCTTGCTCAGACCAGCGATGTGAATAAAATGACTC |
|   | CCAGCAACATTGCGATTGTGTTAGGCCCTAACTTGTTATGGGCCAGAAATGAAGGGACACTTGCTGAAATGGCAGCAGCCACATCC |

TABLE 1-continued

Sequences Table. First column: SEQ ID No. Second column: corresponding mRNA sequence. For the 3 different groups, see explanation in the text.

GTCCATGTGGTTGCAGTGATTGAACCCATCATTCAGCATGCCGACTGGTTCTTCCCTGAAGAGGTGGAATTTAATGTATCAGAAGC
ATTTGTACCTCTCACCACCCCGAGTTCTAATCACTCATTCCACACTGGAAACGACTCTGACTCGGGGACCCTGGAGAGGAAGCGGC
CTGCTAGCATGGCGGTGATGGAAGGAGACTTGGTGAAGAAGGAAAGCTTTGGTGTGAAGCTTATGGACTTCCAGGCCCACCGGCGG
GGTGGCACTCTAAATAGAAAGCACATATCCCCCGCTTTCCAGCCGCCACTTCCGCCCACAGATGGCAGCACCGTGGTGCCCGCTGG
CCCAGAGCCCCCTCCCCAGAGCTCTAGGGCTGAAAGCAGCTCTGGGGGTGGGACTGTCCCCTCTTCCGCGGGCATACTGGAGCAGG
GGCCGAGCCCAGGCGACGGCTGTCCTCCCAAACCGAAGGACCCTGTATCTGCAGCTGTGCCAGCACCAGGGAGAAACAACAGTCAG
ATAGCATCTGGCCAAAATCAGCCCCAGGCAGCTGCTGGCTCCCACCAGCTCTCCATGGGCAACCTCACAATGCTGCAGGGCCCAG
CCCGCATACACTGCGCCGAGCTGTTAAAAAACCCGCTCCAGCACCCCCGAAACCGGGCAACCCACCTCCTGGCCACCCCGGGGGCC
AGAGTTCTTCAGGAACATCTCAGCATCCACCCAGTCTGTCACCAAAGCCACCCACCCGAAGCCCCTCTCCTCCCACCCAGCACACG
GGCCAGCCTCCAGGCCAGCCCTCCGCCCCCTCCCAGCTCTCAGCACCCCGGAGGTACTCCAGCAGCTTGTCTCCAATCCAAGCTCC
CAATCACCCACCGCCGCAGCCCCTACGCAGGCCACGCCACTGATGCACACCAAACCCAATAGCCAGGGCCCTCCCAACCCCATGG
CATTGCCCAGTGAGCATGGACTTGAGCAGCCATCTCACACCCCTCCCCAGACTCCAACGCCCCCAGTACTCCGCCCCTAGGAAAA
CAGAACCCCAGTCTGCCAGCTCCTCAGACCCTGGCAGGGGGTAACCCTGAACTGCACAGCCACATGCTGGAACCTTACCGAGACC
GAGACCAGTACCAAAGCCAAGGAACCGGCCCAGCGTGCCCCCACCCCCCCAACCTCCTGGTGTCCACTCAGCTGGGGACAGCAGCC
TCACCAACACAGCACCAACAGCTTCCAAGATAGTAACAGACTCCAATTCCAGGGTTTCAGAACCGCATCGCAGCATCTTTCCTGAA
ATGCACTCAGACTCAGCCAGCAAAGACGTGCCTGGCCGCATCCTGCTGGATATAGACAATGATACCGAGAGCACTGCCCTGTGAAG
AAAGCCCTTTCCCAGCCCTCCACCACTTCCACCCTGGCGAGTGGAGCAGGGGCAGGCGAACCTCTTTCTTTGCAGACCGAACAGTG
AAAAGCTTTCAGTGGAGGACAAAGGAGGGCCTCACTGTGCGGGACCTGGCCTTCTGCACGGCCCAAGGAGAACCTGGAGGCCACCA
CTAAAGCTGAATGACCTGTGTCTTGAAGAAGTTGGCTTTCTTTACATGGGAAGGAAATCATGCC

85 TGCACCTCCCTCTGCGGTGGGGTCCGGGACATGGCAGGTAATGAGCCGGACGAGGGGAGCCAAGCTGGAGTTTACACAGGCAAACT
GTCAGAAAAGAGTAGCCTGGGCTGTCTGGAAATCTGAGCCATGGACTTTCCCCAGCACAGCCAGCATGTCTTGGAACAGCTGAACC
AGCAGCGGCAGCTGGGGCTTCTCTGTGACTGCACCTTTGTGGTGGACGGTGTTCACTTTAAGGCTCATAAAGCAGTGCTGGCGGCC
TGCAGCGAGTACTTCAAGATGCTCTTCGTGGACCAGAAGGACGTGGTGCACCTGGACATCAGTAACGCGGCAGGCCTGGGGCAGAT
GCTGGAGTTTATGTACACGGCCAAGCTGAGCTTGAGCCCTGAAGACGTGGATGATGTGCTGGCCGTGGCCACTTTCCTCCAAATGC
AGGACATCATCACGGCCTGCCATGCCCTCAAGTCACTTGCTGAGCCGGCTACCAGCCCTGGGGGAAATGCGGAGGCCTTGGCCACA
GAAGGAGGGGACAAGAGAGCCAAAGAGGAGAAGGTGGCCACCAGCACGCTGAGCAGGCTGGAGCAGGCAGGACGCAGCACACCCAT
AGGCCCCAGCAGGGACCTCAAGGAGGAGCGCGGCGGTCAGGCCCAGAGTGCGGCCAGCGGTGCAGAGCAGACAGAGAAAGCCGATG
CGCCCCGGGAGCCGCCGCCTGTGGAGCTCAAGCCAGACCCCACGAGTGGCATGCTGCCGCAGAAGCTGAGGCCGCTTTGTCCGAG
AGCTCGGAGCAAGAAATGGAGGTGGAGCCCGCCCGGAAAGGGGAAGAGGAGCAAAAGGAGCAAGAGGAGCAAGAGGAGGAGGGCGC
AGGGCCAGCTGAGGTCAAGGAGGAGGGTTCCCAGCTGGAGAACGGAGAGGCCCCGAGGAGAACGAGAATGAGGAGTCAGCGGGCA
CAGACTCGGGGCAGGAGCTCGGCTCCGAGGCCCGGGGCCTGCGCTCAGGCACCTACGGCGACCGCACGGAGTCCAAGGCCTACGGC
TCCGTCATCCACAAGTGCGAGGACGTGTGGGAAGGAGTTCACGCACACGGGGAACTTCAAGCGGCACATCCGCATCCACACGGGGGA
GAAGCCCTTCTCGTGCCGGGAGTGCAGCAAGGCCTTTTCCAGACCCGCGCTGCAAGGCCCATGAGAAGACGCACAGCCCTCTGA
AGCCCTACGGCTGCGAGGAGTGCGGGAAGAGCTACCGCTCATCAGCCTGCTGAACCTGCACAAGAAGCGGCACTCGGGCGAGGCG
CGCTACCGCTGCGAGGACTGCGGCAAGCTCTTCACCCACCTCGGCAACCTCAAGCGCCACCAGCTGGTGCACAGCGGCGAGAAGCC
CTACCAGTGCGACTACTGCGGGCCGCTCCTTCTCCGACCCCACTTCCAAGATGCGCCACCTGGAGACCCACGACACGGACAAGGAGC
ACAAGTGCCCACACTGCGACAAGAAGTTCAACCAGGTAGGGAACCTGAAGGCCCACCTGAAGATCCACATCGCTGACGGGCCCCTC
AAGTGCCGAGAGTGTGGGAAGCAGTTCACCCACCTCAGGGAACCTGAAGCGGCACCTTCGGATCCACAGCGGGGAGAAGCCCTACGT
GTGCATCCACTGCCAGCGACAGTTTGCAGACCCCGGCGCTCTGCAGCGGCACGTCCGCATTCACACAGGTGAGAAGCCATGCCAGT
GTGTGATGTGCGGTAAGGCCTTCACCCAGGCCAGCTCCCTCATCGCCCACGTGCGCCAGCACACCGGGGAGAAGCCCTACGTCTGC
GAGCGCTGCGGCAAGAGATTCGTCCAGTCCAGCCAGTTGGCCAATCATATTCGCCACCACGACAACATCCGCCCACACAAGTGCAG
CGTGTGCAGCAAGGCCTTCGTGAACGTGGGGGACCTGTCCAAGCACATCATCATTCACACTGGAGAGAAGCCTTACCTGTGTGATA
AGTGTGGGCGTGGCTTCAACCGGGTAGACAACCTGCGCTCCCACGTGAAGACCGTGCACCAGGGCAAGGCAGGCATCAAGATCCTG
GAGCCCGAGGAGGGCAGTGAGGTCAGCGTGGTCACTGTGGATGACATGGTCACGCTGGCTACCGAGGCACTGGCAGCGACAGCCGT
CACTCAGCTCACAGTGGTGCCGGTGGGAGCTGCAGTGACAGCCGATGAGACGGAAGTCCTGAAGGCCGAGATCAGCAAAGCTGTGA
AGCAAGTGCAGGAAGAAGACCCCAACACTCACATCCTCTACGCCTGTGACTCCTGTGGGGACAAGTTTCTGGATGCCAACAGCCTG
GCTCAGCATGTGCGAATCCACACAGCCCAGGCACTGGTCATGTTCCAGACAGACGCGGACTTCTATCAGCAGTATGGGCCAGGTGG
CACGTGGCCTGCCGGGCAGGTGCTGCAGGCTGGGGAGCTGGTCTTCCGCCCTCGCGACGGGCTGAGGGCCAGCCCGCACTGGCAG
AGACCTCCCTACAGCTCCTGAATGTCCCCCGCCTGCCGAGTGAGCTGGCGGCCCTTCTGACTGTTTATTTAAGGATGGATGGCAC
CCTGGGAACCGGGAAGGGTGGCCTGTTCCCTAGAGAGAATAAATTGGATTATTTTCTAAAAAAA

86 AGCTGACGGCTGGATGACCCCTCTGAACGGTCCCGGCTGTGGATGCCCATAGAGAAACGGGGATTTCACCTTTGGGGCTCTGATTC
TTCCCAGATGAGAGGACGCATCGGGGCTGCCGCTCGCTCTCAGGGCCAGCATGGGGGCTCTGATGGGTCACTTGTTCTTGCCCA
AGGGGTGAATGATGACACAGACTCCATGCCCCACCCCCTCAGCTGCCCAGCCAGTCTGACCAAGACGGAGTGGCCCTTCCACTTCT
ATTCTCCGCGGGTCTCCGAGGATGTGGGATGCGGGAGAGGGAGGAGGGCAGGAGGAAGACCAGGAACGGAGGACGGGAGCTCTGT
GCGAGAGACACGGGTTCAGAAACCCAGCAGCACAGCAGCAAGCGCCCTCCCGCCCCCCGACCAGTGACTCCCACGCAGGTGCAAT
CCACAAAACCACAGGCCACCCAAGGTGTACCCGCCTCTCCCAGGAGCCTTTCTGCCAGAGACCCCAAGCCGGGTGCCCTCCACACT
GGGCCGCAAGGGTAGGTGGGGCCGCTGTGGCACTGGTACCCAGTGGGTGCCTGTCAAACAGGTGTCAACCGACTAATTGCAGCCCA
GCTGGTCCCAGAGACCAGCCAGACAGCCCCTTCCTACTGAGGATGAGGTCCTACACTGCGAGGGCCCCACTGTCCGGCTGTCCCGGA
CACAGCCCCACTAAGCATGCGGGAGGCACCCCACTTGGCACCCCGCAGCCCGGCCCATACCAGCCAGCAGCCTGCCCTGGCTGGC
TGCCCTCCAGCAAGCCATGACTGTCGGCCGGCTTGGAGGACGTCTGGTCACCTTGCATTTGCAGTCTGAGGAAGCTGTGTCATTC
CGCTACATCCAGAGGTGACTCAGGCAGCTGCAGCAGCAGAGCAGACTGCAGAACAACACACCCCCTCCAGTCCCCGCCCTGG
CTCCCACCACACCATCCTCCTGTCCTCGGCCTCCAGCTCCCCATCAGCATCCTGTTCTCCCCGGCCGCCCTGGGCTTCAATCCG
CTCCCAGCCTCTAAGTCCAGTCAGGGGCATTCCGGGGGGCCCAGATGCCCCCAGCCCCAACCGCATCATTCACCGGAGTTGCCC
CTGCCCCTCTCTCTTTTCCTCATCCACGCGCCAACCAGGCTTGATCCCAGCCCTCAAGCATCACCCGCCTGAACCCACAGCACCTG
CCCAGGCTCCGGCCTCCAGCGTCTCCTGTCTGGACACAGTTTGCCAAATGGGATGCCCTCACCCTGATCCTGGTGCCCCACA
CAGCCCCACAGGCAGTCAAAAGTCTTGGGGTTCCTCCCAAACCCGACTCCCCACCCCAATGCCGTTTCAGGTTTCTGATCACC
ATCTGCAGAGAGCACGTGGTTCCCTGCCCTGCTTCTTCCAGAAACACTCCCCACTGCTCTCCTCCTCGCGTAGGCAAGCACCCTCT
ACCAAGGCCTGGTTCTAGATCCTTCTGGGGACAGGGGGCCTCCCCAAGGCATGGTGAGCTCCTTGCAAGCAGGGAGAAGGTCTTCC
CTACACCCCACACTAGCCCCCGCTGTACGAGATGAGGGCAGGGCCTCTACACCAGACCCCACCGGCCTGTGGGACAGGCCAGCAGACCT
CATGGCCTGGGCTTCCTCATCTACAGCAGCTGGTCGGGGGTGGGGCATGTGGCCACTCAAGTTCGCTTGTACCTGCTCTAAAACT
CTATGATTTTAAGACGACACTCCCAGTTTCCTGAAACTGTAGGAAAGCGGAAACATGACGAGTCTGTGACTTATAAAAAGCAAAAA
TAAATAGCGGGGAAAGGCATCTTCCATTCGCGGAGAGCAGGGAGGGTGGGGACGGAGCGGTGAGTCACTGTTTACTGTTGAAAGGC
GGCCACACGGAGCCCTCTCTCAGCTGGCCAGATTTCCATTTCCCGTGTGGACTGGACCCGAAACCCAGAAAGTCCACTCCAGAAAC

TABLE 1-continued

Sequences Table. First column: SEQ ID No. Second column: corresponding mRNA sequence. For the 3 different groups, see explanation in the text.

CTTTAGACTCAGAAACAGCTGGGACAAGAACAGGCACAACTTCTTCTCCGTCTGGGTGGCAAACAGCTTTGCCAGAGACTGTAAAC
AAACGCAGCCATCGCTGAGCCCCGTGGGTGAAAGCACACGCCTTGTAGACAGCGAAGTGGCCCGGAAGACGGTCTCCCTTAACAGC
AGCCTCCCGGGTGCACACAAAGGCTGGCGCCCCGACAACCCTGACCCTCGGTAAACGCTGGCTCCCGGGTTTACCAGCACCTGGGG
AGTCGACGCTGCGGGCAACCAGCCCCTCAAAGCCCTGGCTCGGTTCAAGGATAAAAGGCAGGAGAAGCCTGGTTTTTCTGCTTTAA
TAAATGTCTTATTTTGGAAT

87 ATAGAAGGCACAGAGAAGCACTGAATTGGCTTACATAAGAATAGGCTAGAATTACAAGTAGTGAAACCTCGATTCAGCTGGACAAT
TTTAAACAAATGTATCATTTGGCTTGTATCTTCTGTTGTGCTGGAGAAGTTAGAAATAAGGGCTCTCCAGACCAGCCTGACCAACC
TGGAGAAACCTTGTCTCTGCTAAATACACAAAATTAGCCAGGCGTGGTGGCACATGCCTGTGATCCCAGCTACTTTGGGGGCTGAG
CCAGGAGAATCTCCAGGAGGCGGAGGTTGCTGTGAGCCGGGATCGTGCCATTGCACTCCAGCTTGGGCAACAAGAGTGAAACTCTG
TCCCCCCCCCCCCCCCAAAAAAGTAAGGGCTCTCCATTAGGGCCCATAGAGGACTTTTAATATGGAACTGAATCCAAGGATCCCA
CAATAAGTGGTCAGTAGTTCATGATGAATTAAAAGACTCAATATTTGGTCTTCACCCAATACCTGTGTGACTTTTAGTCCTAATTT
CCTCATCTTTAAAATTTCAGTGAAAGTGCCTACCTGAAGATTGTGTAGATTAAAATGGAAACCGTGCACTTAATTTTTTGTTTTGT
TTTGAGACGGAGTCTCGCTCTGTCGCCCAGGCTGGAGTGCAGTGGTGCGAGCTCAGATCACTGCAAGCTCCGCCTCCTAGGTTCAG
ACCATTCTCCTGCCTCAGCTTCCCAAGTAGCTGGGACTACAGGCGCCCGCCACTGCGCCCGGCTAATTTTTTGCATTTTTAGTAGA
GACAGGGTTTCACCGTGTTAGCCAGGATGGTCTCGATCTCCTGATCTGCCCGCCTCAGCCTCCCAAAGTGCTGGGATTACAGGCAT
GAGCCACCGCGCCCGGCCCAGGCACTTAATTTTTGTGTTTGACTTAGTAACAAGTGCAAACTATTACGGGAGCAGATGGAGTCAAT
TGGCCTTCATGTGACTGTCAGTGGGAAATTGGTCCAAGCAGAGGGAATACTGGTTCAGGAAACTGGTTTGGGAAGGTTAGGCAAAC
GGGAAGTGCTATGGTGGAGAGAAAGATTACTCTGGCCGGGCTGTAAAGGACGGCTACAATGGGAGGCTGAAGGCAGAACCAAGAA
ATGGGAGTGAGTATGGAAAAGGTACGATTCAGACGGCATAATGGACGGGACTTGGAGACTGAATTGTAGTGGGCCGACCACAAAAT
GATAAGGCATGGAAGGAAGTAGAGTTTGGGGGGAAGGATCCCTAGTCCCTTAATGGCTACCTTCTTCCCCAGGAGTTGTTAGGCCA
TCCGATCCCCTGGGCTGGGAAAGAAACACTGATTTCGTTGCTGGCTTGTTCACTCACCAGAAGCTACAGCTACTAACAGTTCTAAA
AACTGTTTCATGTGATGAGGAACAGACGAAAATAGTTTTGAGCCCTAAGTCCGCCGATTCCAGTGCTTTCTTGAACCCGCATTTAC
TAAAATATTTTCATGACTGCCAAGCTTTGAATAGCCTGCTGTGTTCATGGAGGCTCATACTGGCGATCTCTAGTGGCTGGCTAAAG
CTTGAATTGCAAAAGATCTAATTTCTGGTCTAATGTATATATGCCTTAAATATAGTTGCGTTCAAACGTGGGAGCTGCAGGTGCAA
CTTGATTTTATGACAAATGTCTGCCACATAATTTGCACAAGCAGTGCTCGTCAAGGGCAGCTAAATCAGGCGAGCTTTCAATCAAA
ATAAATGTACTACTAAACCCTACTTAGCGGCTAACTAGCCCAAGAGCAGACAGCCCACGGACGGACTGCAAGTCGGAAGCGCGGGC
GGAAGCTGTGCAGCGCCCACCTGGTGGCTCCATCGGCCGCGTTCATCAGTCAGCACGACCCGACCTCAGTGGCGTCCTCACAACAC
AGACCGGACCTTGGGTCTTACCCCGGCACCTGAGAACCACTTCCGGTGAGTAGCTTCTACTTCCGGAGACGATGACTCCCCCGCGT
CCCAGACCGGAAGAAGCCCGGCGGAGACCGGCCTCGCTCGGCCCACTTCCGGCAAGGGCGGAGCCGGCCAGTGGTGCGCGAGCGCAG
ATAACTCCCCTGGAGAGGCGGGATGTTCAACTCCACCCCTGGTCCTTGGGCGGCCGTGGGTCCCCTTCGAAGCGGAGGAATGGCCA
ACCTCGCCGCACTTCGAGCCCCTTTAGGGTGCGTTTAAGAACAGTGGGCGTGGCCTTTACGTAAATCTTCGAGATGGGAACCTCCA
GAATTTGTCTCAATTGTCTAAAAGGTAATGAGCGTCAGCGACATTCAAGGGCTCTTTGGGCTAAAAAGAAAGTGCTTGTACACGG
ATGGAAATATTCTAGAAGAACATAAAAGGAATTTCCTCTTAGGAGGTTAGGGAAATGACGAAGTATGTTTTGGTGCAGTTTTT
TGTTCAACCCAATGCGTATTTTCATATTGAGAGGCAATATAAATGGAGCGAAAGTATCTTGAGAAAAAAAAAACTACCAGAACTT
GCCGTTGCTGAAAAGTAATATTTTCTCTTTCGAGAGTTTTCATGGCCTTTTAAATTACACCCCCACCTCCACAGGCAAATAAATTT
GTTTTGGAATGCATACCAC

88 CTACGCCAGGCTCTGAGGCTTGGATTTCATGCAGTGGGATCCATCTCTTTTTTATGCAATTCACTTTGATTTCATTAACATTTCTT
ATTTGTTGTTAGATTCATTTGGAGTTAAAACAGCAGATCGTTACAGTTTTTAACTCAGAGGTTTAGAGGCTGTTATATTCATGAT
CCTCCACAAGGTGGCAATGCCTTCCTTGATTAGATTTTTTCTTCCCGTTCCATTTCACTGCAGGTGGGTTTGCGTGTCATTGCGT
TGCCAAAACACCCTCACCCACTGTTCCTTCTCGCAGTGATCTGCTCTAGAATTTGGGGGTTGGGACTGGACTTCTGAATATCATCT
AGGTCATTTTCCCATTCTCTGGATTGGACCATACTTAAACTATCCCAAGCAGATATTCTCATTTATAGTACTTTTTAAACTTGTT
GAATTCTTTATCTTTTAAAGAAGATAATTTCTAAGATATTATGAAATACCTATTATGTGAAAACAACAGACAAACAATAAACCCCA
ATTGAAACTAGTCTCTGGGAGTGGGGCTCAGGCATCTGGATGGTCTTAAAGCGTCCTACTGACTTTCATCTAACTAGGGTTGAAGC
CACCGCTCCAGTGCGTAGCCCCTAACCTCGGACACCTTTGTGGGCGTAGGCTGATGAGATAGTGAGGTCAGGGTCTAGACAGGTG
CACCCAAGTTACTGCAGGAGTCAAAAGATGGCCAGATTGTATCTCCTTAGAACATACAGAACATCTTTCCGGCAAGAATATTCATT
CAAGAAGATTTTAAAGGGTGAATAACATTTCAGTAAGATATAAAAAGACGTTTGAGGAGATAGAAATAGCAAAAGGAAAGTTAGA
ATCAGGAAAGTAGCGTCCTCCCTCTGTGGTTTTAAAAAAAGTCGTATAAAGGCTGTAAAATTGATTTGGTGTTTTTCTCTCCTTGT
GGTAAACAAAAAGTAGGTTAAATTTGTTCAAGATAAATAATTGATCAAGTAGGTTTCAGAGTGTTTTCTATAGTATTTTGGTG
AGCCTACTTTATTTTTCTCCAATAGTACCCCGAGATTTTCCTTATGAAGAGGACTCAAGACCTCGATCACAGTCTTCCAAAGCAGC
CATTCCTCCCCAGTGTACGAGGAACAAGACAGACCGAGATCTCCAACCGGACCTAGCAACTCCTTCCTCGCTAACATGGGGGCA
CGGTGGCGCACAAGATCATGCAGAAGTACGGCTTCCGGGAGGGCCAGGGTCTGGGGAAGCATGAGCAGGGCCTGAGCACTGCCTTG
TCAGTGGAGAAGACCAGCAAGCGTGGCGGCAAGATCATCGTGGGGACGCCACAGAGAAAGGTGTGTCCCCAGGGAAGCGTGTGAC
TAGAGGGAAAGGACTGGCCCCATCCATATCAGACATGGCCAGTCTTGATCCTCATGTGTCAGCAGGGGACAATGAGGCGTGTGGC
CAGAGGGAGAGGGCTGGCCCTGCCATCACTAGAACACAGGCCGTCCTGTTCATATGATGCACTGCCACTTCCGTTTTGTGAAACCA
GGAATCCTGAGGCTCATCTTTATTTTTCAGAACAGACGTAGAGAGATGAAGGCTTGTGGAGGAAAAGATGGTGAGAGACTTGGGC
AGAAAATGAGTAGTCCTCAGGAAGAAATCTTGGTTATGTGTTTAGAGCATGAAGGACAGAGCCATATAGTGTGGCAGTGAATATAC
CTGCTATCTCCATCTCAGAGGTCGTCTCTACTTTTCCCTTTTGCCCTTTCGATGTAGATGTGATTTTCTGATTCTCTTACAGATTGT
TTGCTTTGCGAGATCTGATGTTATGTTGCAGTCTCTTGGTAAATGATGCCTAGTTGGTGTTTTATTTTCATTTAATTTTTACAGTC
TGTTCTGTGTTGAGGGAATTCAGGAAAGAGACAAACATATGTTAGCATTTTAATCAGGGAATTAAGTTTGAGTCAGCCTAGCTGAA
CTTCCTTTGCTAAAGAAAGAAGAAAACTTTTCTGGCAGCCCCGTTCATGCACAGCTTAGGATACATCACGAGCCTGACAGGTGAGT
GCCAGAAACCAACAGTTGTCCCGACTTGTGTGGTTATCTGAAGTAAGGCAGCCGGTGGCTGGATTAGTAACTGCATATTCCCCTGG
GCCCGTGACCTTGAACGTTTGCTCCAAGTCAACTCACCTATAGGAATTATCACTCACATGCCCTGTCAGCCCTTTGGGAAGTGAGA
TGAGCAAAAATTGCAAGTAATGGTGGAGGCTCAAAACATCCAGATGCTATTGTAAAAACATGCCAAAGCAAAGCAGAGGCTTTAT
TGCAGATAAGGCTGTGTTTTCGCTCAGAGACCAATTGTGTAGATGCCTAGGACATAAATGGTGGGGATCGCTATTGAAATTAAATT
AATTATTGTAAGTAGGACTCAGTTCTGTAACACATCTAATGATATGCTGTAGTCTGTAACACATCTAATGGTATGTTTTGATA
CAGATGCATCCAAGAAGTCAGATTCAAATCCGCTGACTGAAATACTTAAGTGTCCTACTAAAGTGGTCTTACTAAGGGTAAGAAGC
TGAGGAAAGCAAGCTCTCTGCCTGCCTAGATTTGTGTGTGTCACCCCAGCCTACCCTGCTCCCCTAAAAGTTAAAACTGAAAATG
ATACTTTTGCAAATAATACTTTGGGCAGATCCCACGTAAGGCTGATTTTAGATTTTTCACTAATGTGTAAGTCTCTTTGCTAAGTA
CAGTGTTTAAGACTGCAGTGAGTAATTAAATATTTGAAATTGCTAGAGCTTCAGATAGTTTATACATTTTGGTTGCATGAGATAGATG
CTTTTGTAACTCTTTACAGGCTTAATATATGTTTTAGTGTTTAAGAAATACTAACTTCTGGGTACTTTGGGGATGAAATTTTCA
TTATGTCGTTTGGGATTGAGAACATTTACCATCACTAAGTCATATTTATACCCTCTGCTAGGTGTTTGTAAGTTATACTTGGTAC
TTGAATTTGTTTATTTTTGTGTTTAAAGAACATGGTTGGTGCGGGAGAGGTGGATGAGGACTTGGAAGTTGAAACCAAGGAAGAAT
GTGAAAAATATGGCAAAGTTGGAAAATGTGTGATATTTGAAGTAAGAGCGTTTTCTTTTGATGTTTATAACACAAGTTGTAATTGG
CACATTACAAAACATTTTCTACAAACAGGACAGGGTATGCTATAAGTAACATTCTTACTGCAGAAGGTGACAGGCGTTGGTTATTT

TABLE 1-continued

Sequences Table. First column: SEQ ID No. Second column: corresponding mRNA sequence. For the 3 different groups, see explanation in the text.

| | |
|---|---|
| | GTACTTCTCTTGCTCAATTATTACAGTTTTAAACATAAAGACAATGATTTCAAGTTTTATTTGATGAAGAAACAGGAATGCTTCAT<br>GATTGAGGATCAGTATGATGACTGAAGACCTTGATTCTAGCGTGCTCAGTAGTTTAGTTCCTTAGACATGCCTTTGGTTTCGGTCA<br>TTTGGTGAGTATTTAGTGCCTCTCACATGCACTGCACTGTGCGGAGAGCACTTGGATTACAGGGAGCATGCTCTGTACTCTCAGTG<br>GTGTGTTCAGTTGAAGAAACACATAAAATAACTGAAAGATATTCAGTTACTAGACTAGGTAGTATTGACTAAGTTCAGGAGTTGAG<br>AAAAGGATTAGATCAGTGAAAAAATAGACTGCCTTGTGAGCAATAGCAGATATGGGCTGCGCTTTGAAACGAACAGGTGGGATTTG<br>CAGGGAAGGGTATTCTGATTGGGATAATGGCTCGTAGGAGACAGTGAAGATCAGGACTACCAAAATGGAATGGATGGGCCTGTTGG<br>GGATTAGCAGAAGTGCTTAGGTGGGTGGAATTACAGAGGGCTAGGAAAGCTAGACAGAGCTAGTCAAAATGAGACCTGATGTGAAA<br>GGCCACTAGGGCACCAGCCTTTTTAATCTGAAAGCTCTGCTTCCTCTGTTTCTTTATCCTGTTGCTGTTTGTTGACCACATAATTA<br>TTTGTTTACGTCATCAGCTGGCACAGGGCCTTTATGAGGTCAGAGACTGCCTAGCCCTGTGTTCCTGGCACCTAACAATGCCTGTC<br>ATAAAAACAGGCATTCAGTACGTTTTTGATGATGAACAAATTATACTTATTTCCTTGGTATTTGACAACTACTTGACTGTATATGA<br>TGATAATTAGAATATCCACTCTGAGAAATCATTTAAAAGAGAAAACTCATTCAATGCAATCTCAAATGCCTTTACTCATCACGCTC<br>TCATTTTCTTCCAGATTCCTGGTGCCCCTGATGATGAAGCAGTACGGATATTTTAGAATTTGAGAGAGTTGAATCAGCAATTAAA<br>GGTTAGTGGTACAGCTAAATATTAAAGAATAAAAAAGTTGAATTTACAGCCTTAATCTTTACAAGTAAAGTTACTGTTTAATTAAA<br>GTTAAACCTTTATCTTATAGGATACCTGTATTAACTGTCTTTTGTTTGCCTTTCAGCGGTTGTTGACTTGAATGGGAGGTATTTTG<br>GTGGACGGGTGGTAAAAGCATGTTTCTACAATTTGGACAAATTCAGGGTCTTGGATTTGCAGAACAAGTTTGATTTTAAGAACTA<br>GAGCACGAGTCATCTCCGGTGATCCTTAAATGAACTGCAGGCTGAGAAAAGAAGGAAAAAGGTCACAGCCTCCATGGCTGTTGCAT<br>ACCAAGACTCTTGGAAGGACTTCTAAGATATATGTTGATTGATCCCTTTTTTTATTTTGTGGTTTTTTAATATAGTATAAAAATCCT<br>TTTAAAAAAACAACAATCTGTGTGCCTCTCTGGTTGTTTCTCTTTTTTATTATTACTCCTGAGTTGATGACATTTTTTGTTAGATT<br>TCATGGTAATTCTCAAGTGCTTCAATGATGCAGCATTTCTTGCACTAAAAAAAAAAAAAAAAAAACA |
| 89 | GAGCAATTGATTAATAGCTCGGCGAGGGGACTCACTGACTGTTATAATAACACTACACCAGCAACTCCTGGCTTCCCAGCAGCCGG<br>AACACAGACAGGAGAGAGTCAGTGGCAAATAGACATTTTTCTTATTTCTTAAAAAACAGCAACTTGTTTGCTACTTTTATTTCTGT<br>TGATTTTTTTTTCTTGGTGTGTGTGGTGGTTGTTTTAAGTGTGGAGGGCAAAAGGAGATACCATCCCAGGCTCAGTCCAACCCCT<br>CTCCAAAACGGCTTTTCTGACACTCCAGGTAGCGAGGGAGTTGGGTCTCCAGGTTGTGCGAGGAGCAAATGATGACCGCCAAGGCC<br>GTAGACAAAATCCCAGTAACTCTCAGTGGTTTTGTGCACCGACTGTCTGACAACATCTACCCGGTGGAGGACCTCGCCGCCACGTC<br>GGTGACCATCTTTCCCAATGCCGAACTGGGAGGCCCCTTTGACCAGATGAACGGAGTGGCCGGAGATGGCATGATCAACATTGACA<br>TGACTGGAGAGAAGAGGTCGTTGGATCTCCCATATCCCAGCAGCTTTGCTCCCGTCTCTGCACCTAGAAACCAGACCTTCACTTAC<br>ATGGGCAAGTTCTCCATTGACCCTCAGTACCCTGGTGCCAGCTGCTACCCAGAAGGCATAATCAATATTGTGAGTGCAGGCATCTT<br>GCAAGGGGTCACTTCCCCAGCTTCAACCACAGCCTCATCCAGCGTCACCTCTGCCTCCCCCAACCCACTGGCCACAGGACCCCTGG<br>GTGTGTGCACCATGTCCCAGACCCAGCCTGACCTGGACCACCTGTACTCTCCGCCACCGCCTCCTCCTCCTTATTCTGGCTGTGCA<br>GGAGACCTCTACCAGGACCCTTCTGCGTTCCTGTCAGCAGCCACCACTTCCACCTCTTCCTCTCTGGCCTACCCACCACCTCCTTC<br>CTATCCATCCCCCAAGCCAGCCACGGACCCAGGTCTCTTCCCAATGATCCCAGACTATCCTGGATTCTTTCCATCTCAGTGCCAGA<br>GAGACCTACATGGTACAGCTGGCCCAGACCGTAAGCCCTTTCCCTGCCCACTGGACACCCTGCGGGTGCCCCCTCCACTCACTCCA<br>CTCTCTACAATCCGTAAGCCCTTTCCCTGCCCACTGGACACCCTGCGGGTGCCCCCTCCACTCACTCCACTCTCTACAATCCGTAA<br>CTTTACCCTGGGGGGCCCCAGTGCTGGGGTGACCGGACCAGGGGCCAGTGGAGGCAGCGAGGGACCCCGGCTGCCTGGTAGCAGCT<br>CAGCAGCAGCAGCAGCCGCCGCCGCCGCCTATAACCCACACCACCTGCCACTGCGGCCCATTCTGAGGCCTCGCAAGTACCCC<br>AACAGACCCAGCAAGACGCCGGTGCACGAGAGGCCCTACCCGTGCCCAGCAGAAGGCTGCGACCGGCGGTTCTCCCGCTCTGACGA<br>GCTGACACGGCACATCCGAATCCACACTGGGCATAAGCCCTTCCAGTGTCGGATCTGCATGCGCAACTTCAGCCGCAGTGACCACC<br>TCACCACCCATATCCGCACCCCACACCGGTGAGAAGCCCTTCGCCTGTGACTACTGTGGCCGAAAGTTTGCCCGGAGTGATGAGAGG<br>AAGCGCCACACCAAGATCCACCTGAGACAGAAAGAGCGGAAAAGCAGTGCCCCCTCTGCATCGGTGCCAGCCCCCTCTACAGCCTC<br>CTGCTCTGGGGCGTGCAGCCTGGGGTACCCTGTGCAGCAGTAACAGCAGCAGTCTTGGCGGAGGGCCGCTCGCCCCTTGCTCCT<br>CTCCGACCCGGACACCTTGAGATGAGACTCAGGCTGATACACCCAGCTCCCAAAGGTCCCGGAGGCCCTTTGTCCACTGGAGCTGCA<br>CAACAAACACTACCACCCTTTCCTGTCCCTCTCTCCCTTTGTTGGGCAAAGGGCTTTGGTGGAGCTAGCGTGCCCCCTTTCCACC<br>TAGAAGCAGGTTCTTCCTAAAACTTAGCCCATTCTAGTCTCTCTTAGGTGAGTTGACTATCAACCCAAGGCAAAGGGGAGGCTCAG<br>AAGGAGGTGGTGTGGGGACCCCTGGCCAAGAGGGCTGAGGTCTGACCCTGCTTTAAAGGGGTTGTTTGACTAGGTTTTGCTACCCCA<br>CTTCCCCTTATTTTGACCCATCACAGGTTTTTGACCCTGGATGTCAGAGTTGATCTAAGACGTTTTCTACAATAGGTTGGGAGATG<br>CTGATCCCTTCAAGTGGGGACAGCAAAAAGACAAGCAAAACTGATGTGCACTTTATGGCTTGGGACTGATTTGGGGGACATTGTAC<br>AGTGAGTGAAGTATAGCCTTTATGCCACACTCTGTGGCCCTAAAATGGTGAATCAGAGCATATCTAGTTGTCTCAACCCTTGAAGC<br>AATATGTATTATAAACTCAGAGAACAGAAGTGCAATGTGATGGGAGGAACATAGCAATATCTGCTCCTTTTCGAGTTGTTTGAGAA<br>ATGTAGGCTATTTTTTCAGTGTATATCCACTCAGATTGTTCTGTATTTTTGATGGTATTTTCTCTAAATTCTGAATCTTTGGGAA<br>AAAATGTAAAGCATTTATGATCTCAGAGGTTAACTTATTTAAGGGGGATGTACATATATTCTCTGAAACTAGGATGCATGCAATTG<br>TGTTGGAAGTGTCCTTGGTGCCTTGTGTGATGTAGACAATGTTACAAGGTCTGCATGTAAATGGGTTGCCTTATATGGAGAAAAA<br>AATCACTCCCTGAGTTTAGTATGGCTGTATATTTCTGCCTATTAATATTTGGAATTTTTTTAGAAAGTATATTTTTGTATGCTTT<br>GTTTTGTGACTTAAAAGTGTTACCTTTGTAGTCAAATTTCAGATAAGAATGTACATAATGTTACCGGAGCTGATTTGTTTGGTCAT<br>TAGCTCTTAATAGTTGTGAAAAAATAAATCTATTCTAACGCAAAACCACTAACTGAAGTTCAGATAATGGATGGTTTGTGACTATA<br>GTGTAAATAAATACTTTTCAACAATAAAAAAAAAAAAAAAAAAAAAAAAA |
| 90 | ACGCGTCCGGCGGCTTCTATTTGCGGTTCAGGTTTGGCCGCTGCCGGCCAGCGTCCTCTGGCCATGGACACCCCGGAAAATGTCCT<br>TCAGATGCTTGAAGCCCACATGCAGAGCTACAAGGGCAATGACCCTCTTGGTGAATGGGAAAGATACATACAGTGGGTAGAAGAGA<br>ATTTTCCTGAGAATAAAGAATACTTGATAACTTTACTAGAACATTTAATGAAGGAATTTTTAGATAAGAAGAAATACCACAATGAC<br>CCAAGATTCATCACTTATTGTTTAAAATTTGCTGAGTACAACAGTGACCTCCATCAATTTTTTGAGTTTCTGTACAACCATGGGAT<br>TGGAACCCTGTCATCCCCTCTGTACATTGCCTGGGCGGGCATCTGGAAGCCCAAGGAGAGCTGCAGCATGCCAGTGCTGTCCTTC<br>AGAGAGGAATTCAAAACCAGGCTGAACCCAGAGAGTTCCTGCAACAACAATACAGGTTATTTCAGACACGCCTCACTGAAACCCAT<br>TTGCCAGCTCAAGCTAGAACCTCAGAACCTCTGCATAATGTTCAGGTTTTAAATCAAATGATAACATCAAATCAAATCCAGGAAA<br>TAACATGGCCTGCATTTCTAAGAATCAGGGTTCAGAGCTTTCTGGAGTGATATCTTCAGCTTGTGATAAAGAGTCAAATATGGAAC<br>GAAGAGTGATCACGATTTCTAAATCAGAATATTCTGTGCACTCATCTTTGGCATCCAAAGTTGATGTTGAGCAGGTTGTTATGTAT<br>TGCAAGGAGAAGCTTATTCGTGGGGAATCAGAATTTTCCTTTGAAGAATTGAGAGCCCAGAAATACAATCAAATGAAAAACATGA<br>GCAATGGGTAAATGAAGACAGACATTATATGAAAAGGAAAGAAGCAAATGCTTTTGAAGAACAGCTATTAAACAGAAAATGGATG<br>AACTTCATAAGGAAGTTGCATCAGGTGGTGGAGACATCCCATGAGGATCTGCCCGCTTCCCAGGAAAGGTCCGAGGTTAATCCAGCA<br>CGTATGGGCCAAGTGTAGGCTCCCAGCAGGAACTGAGAGCGCCATGTCTTCCAGTAACCTATCAGCAGACACCAGTGAACATGGA<br>AAAGAACCCAAGAGAGCACCTCCTGTTGTTCCTCCTTTGCAGCAGTAACAGACTCCATGTTTGCAGTGGCCAGCAAAGATGCTGGATGTGTGAAT<br>GCATTGCTCCTCCTGTTCCTTTGAAAGCCCAGACAGTAACAGACTCCATGTTTGCAGTGGCCAGCAAAGATGCTGGATGTGTGAAT<br>AAGAGTACTCATGAATTCAAGCCACAGAGTGGAGCAGAGATCAAAGAAGGGTGTGAAACACATAAGGTTGCCAACACAAGTTCTTT<br>TCACACAACTCCAAACACATCACTGGGAATGGTTCAGGCAACGCCATCCAAAGTGCAGCCATCACCCACCGTGCACACAAAAGAAG<br>CATTAGGTTTCATCATGAATATGTTTCAGGCTCCTACACTTCCTGATATTTCTGATGACAAAGATGAATGGCAATCTCTAGATCAA<br>AATGAAGATGCATTTGAAGCCCAGTTTCAAAAAAATGTAAGGTCATCTGGGGCTTGGGGAGTCAATAAGATCATCTCTTCTTTGTC |

TABLE 1-continued

Sequences Table. First column: SEQ ID No. Second
column: corresponding mRNA sequence. For the 3 different
groups, see explanation in the text.

```
   ATCTGCTTTTCATGTGTTTGAAGATGGAAACAAAGAAAATTATGGATTACCACAGCCTAAAAATAAACCCACAGGAGCCAGGACCT
   TTGGAGAACGCTCTGTCAGCAGACTTCCTTCAAAACCAAAGGAGGAAGTGCCTCATGCTGAAGAGTTTTTGGATGACTCAACTGTA
   TGGGGTATTCGCTGCAACAAAACCCTGGCACCCAGTCCTAAGAGCCCAGGAGACTTCACATCTGCTGCACAACTTGCGTCTACACC
   ATTCCACAAGCTTCCAGTGGAGTCAGTGCACATTTTAGAAGATAAAGAAAATGTGGTAGCAAAACAGTGTACCCAGGCGACTTTGG
   ATTCTTGTGAGGAAAACATGGTGGTGCCTTCAAGGGATGGAAAATTCAGTCCAATTCAAGAGAAAAGCCCAAAACAGGCCTTGTCG
   TCTCACATGTATTCAGCATCCTTACTTCGTCTGAGCCAGCCTGCTGCAGGTGGGGTACTTACCTGTGAGGCAGAGTTGGGCGTTGA
   GGCTTGCAGACTCACAGACACTGACGCTGCCATTGCAGAAGATCCACCAGATGCTATTGCTGGGCTCCAAGCAGAATGGATGCAGA
   TGAGTTCACTTGGGACTGTTGATGCTCCAAACTTCATTGTTGGGAACCCATGGGATGATAAGCTGATTTTCAAACTTTTATCTGGG
   CTTTCTAAACCAGTGAGTTCCTATCCAAATACTTTTGAATGGCAATGTAAACTTCCAGCCATCAAGCCCAAGACTGAATTTCAATT
   GGGTTCTAAGCTGGTCTATGTCCATCACCTTCTTGGAGAAGGAGCCTTTGCCCAGGTGTACGAAGCTACCCAGGGAGATCTGAATG
   ATGCTAAAAATAAACAGAAATTTGTTTAAAGGTCCAAAAGCCTGCCAACCCCTGGGAATTCTACATTGGGACCCAGTTGATGGAA
   AGACTAAAGCCATCTATGCAGCACATGTTTATGAAGTTCTATTCTGCCCACTTATTCCAGAATGGCAGTGTATTAGTAGGAGAGCT
   CTACAGCTATGGAACATTATTAAATGCCATTAACCTCTATAAAAAATACCCCTGAAAAAGTGATGCCTCAAGGTCTTGTCATCTCTT
   TTGCTATGAGAATGCTTTACATGATTGAGCAAGTGCATGACTGTGAAATCATTCATGGAGACATTAAACCAGACAATTTCATACTT
   GGAAACGGATTTTTGGAACAGGATGATGAAGATGATTTATCTGCTGGCTTGGCACTGATTGACCTGGGTCAGAGTATAGATATGAA
   ACTTTTTCCAAAAGGAACTATATTCACAGCAAAGTGTGAAACATCTGGTTTTCAGTGTGTTGAGATGCTCAGCAACAAACCATGGA
   ACTACCAGATCGATTACTTTGGGGTTGCTGCAACAGTATATTGCATGCTCTTTGGCACTTACATGAAAGTGAAAAATGAAGGAGGA
   GAGTGTAAGCCTGAAGGTCTTTTTAGAAGGCTTCCTCATTTGGATATGTGGAATGAATTTTTTCATGTTATGTTGAATATTCCAGA
   TTGTCATCATCTTCCATCTTTGGATTTGTTAAGGCAAAAGCTGAAGAAAGTATTTCAACAACACTATACTAACAAGATTAGGGCCC
   TACGTAATAGGCTAATTGTACTGCTCTTAGAATGTAAGCGTTCACGAAAATAAAATTTGGATATAGACAGTCCTTAAAAATCACAC
   TGTAAATATGAATCTGCTCACTTTAAACCTGTTTTTTTTTTTCATTTATTGTTTATGTAAATGTTTGTTAAAAATAAATCCCATGGAA
   TATTTCCCTGTTTTAAAAAAAAAAAAAAAAAAAAAAAAAAAAAAAAAAAAAA

91 TTTTTTTTTTAATCATGCTTTTCTTTATTCACCTCATATAAAAGTCTCTTTAGAATGCATTTGAACACAATATATAATAATAATAC
   TATAACATACATTGTGAGAAACATTTGAAAATGATAAAATGTCCACCTGAAACAATGCAGTGTTCATAGACATACATTGGTCATGC
   ACATTTGTGCCATTTTCTGTAATTACTGAGTCACAATGCTGAACTGAAAGCATGAAACATATTTTACAAACTGAAACTGACATCA

92 GCAGAGCACCGCGCCTTAGCCGCGAAGTTCTAGTTCTTGCTGCCGGTCCTAACGTCCCGCAGTCTTCGCCAGCCAGCCGTCCCGCA
   TGCGCGTTTGGGCGGCGTGGAGCCTGCTGCCATGAAGTCAGCGAGAGCTAAGACACCCCGGAAACCTACCGTGAAAAAAGGGTCCC
   AAACGAACCTTAAAGACCCAGTTGGGGTATACTGTAGGGTGCGCCCACTGGGCTTTCCTGATCAAGAGTGTTGCATAGAAGTGATC
   AATAATACAACTGTTCAGCTTCATACTCCTGAGGGCTACAGACTCAACCGAAATGGAGACTATAAGGAGACTCAGTATTCATTTAA
   ACAAGTATTTGGCACTCACACCACCCAGAAGGAACTCTTTGATGTTGTGGCTAATCCCTTGGTCAATGACCTCATTCATGGCAAAA
   ATGGTCTTCTTTTTACATATGGTGTGACGGGAAGTGGAAAAACTCACACAATGACTGGTTCTCCAGGGGAAGGAGGGCTGCTTCCT
   CGTTGTTTGGACATGATCTTTAACAGTATAGGGTCATTTCAAGCTAAACGATATGTTTTCAAATCTAATGATAGGAATAGTATGGA
   TATACAGTGTGAGGTTGATGCCTTATTAGAACGTCAGAAAAGAGAAGCTATGCCCAATCCAAAGACTTCTTCTAGCAAACGACAAG
   TAGATCCAGAGTTTGCAGATATGATAACTGTACAAGAATTCTGCAAAGCAGAAGAGGTTGATGAAGATAGTGTCTATGGTGTATTT
   GTCTCTTATATTGAAATATATAATAATTACATATATGATCTATTGGAAGAGGTGCCGTTTGATCCCATAAAACCCAAACCTCCACA
   ATCTAAATTGCTTCGTGAAGATAAGAACCATAACATGTATGTTGCAGGATGTACAGAAGTTGAAGTGAAATCTACTGAGGAGGCTT
   TTGAAGTTTTCTGGAGAGGCCAGAAAAAGAGACGTATTGCTAATACCCATTTGAATCGTGAGTCCAGCCGTTCCCATAGCGTGTTC
   AACATTAAATTAGTTCAGGCTCCCTTGGATGCAGATGGAGACAATGTCTTACAGGAAAAAGAACAAATCACTATAAGTCAGTTGTC
   CTTGGTAGATCTTGCTGGAAGTGAAAGAACTAACCGGACCAGAGCAGAAGGGAACAGATTACGTGAAGCTGGTAATATTAATCAGT
   CACTAATGACGCTAAGAACATGTATGGATGTCCTAAGAGAGAACCAAATGTATGGAACTAACAAGATGGTTCCATATCGAGATTCA
   AAGTTAACCCATCTGTTCAAGAACTACTTTGATGGGGAAGGAAAAGTGCGGATGATCGTGTGTGTGAACCCCAAGGCTGAAGATTA
   TGAAGAAACTTGCAAGTCATGAGATTTGCGGAAGTGACTCAAGAAGTTGAAGTAGCAAGACCTGTAGACAAGGCAATATGTGGTT
   TAACGCCTGGGAGGAGATACAGAAACCAGCCTCGAGGTCCAGTTGGAAATGAACCATTGGTTACTGACGTGGTTTTGCAGAGTTTT
   CCACCTTTGCCGTCATGCGAAATTTTGGATATCAACGATGAGCAGACACTTCCAAGGCTGATTGAAGCCTTAGAGAAACGACATAA
   CTTACGCAAATGATGATTGATGAGTTTAACAAACAATCTAATGCTTTTAAAGCTTTGTTACAAGAATTTGACAATGCTGTTTTAA
   GTAAAGAAACCACATGCAAGGGAAACTAAATGAAAAGGAGAAGATGATCTCAGGACAGAAATTGGAAATAGAACGACTGGAAAAG
   AAAAACAAAACTTTAGAATATAAGATTGAGATTTTAGAGAAACAACTACTATCTATGAGGAAGATAAACGCAATTTGCAACAGGA
   ACTTGAAACTCAGAACCAGAAACTTCAGCGACAGTTTTCTGACAAACGCAGATTAGAAGCCAGGTTGCAAGGCATGGTGACAGAAA
   CGACAATGAAGTGGGAGAAAGAATGTGAGCGTAGAGTGGCAGCCAAACAGCTGGAGATGCAGAATAAACTCGGGTTAAAGATGAA
   AAGCTGAAACAACTGAAGGCTATTGTTACTGAACCTAAAACTGAGAAGCCAGAGAGACCCTCTCGGGAGCGAGATCGAGAAAAAGT
   TACTCAAAGATCTGTTTCTCCATCACCTGTGCCTCTTTCTAGTAACTATATTGCTCAGATTTCCAACGGCCAGCAACTCATGAGCC
   AGCCACAGCTACATAGGCGCTCTAACTCTTGCAGCAGCATTTCTGTAGCTTCCTGTATTTCGGAATGGGAGCAGAAAATTCCTACG
   TACAACACACCTCTCAAAGTCACATCTATTGCAAGGCGTAGGCAGCAGGAGCCAGGACAAAGCAAAACTTGTATCGTGTCAGACAG
   AAGGCGAGGGATGTACTGGACTGAAGGCAGGGAGGTGGTTCCTACATTCAGAAATGAGATAGAAATAGAAGAGGATCATTGCGGCA
   GGTTACTCTTTCAACCTGATCAGAACGCACCACCAATTCGTCTCCGACACAGACGATCACGCTCTGCAGGAGACAGATGGGTAGAT
   CATAAGCCGCCGCTCTAACATGCAAATGAAACAGTCATGCAGCCACATGTCCCTCATGCCATCACAGTATCTGTTGCAAATGAAAA
   GGCACTAGCTAAGTGTGAGAAGTACATGCTGACCCACCAGGAACTAGCCTCCGATGGGAGATTGAAACTAAACTAATTAAGGGTG
   ATATTTATAAAACAAGGGGTGGTGGACAATCTGTTCAGTTTACTGATATTGAGACTTTAAAGCAAGAATCACCAAATGGTAGTCGA
   AAACGAAGATCTTCCACAGTAGCACCTGCCCAACCAGATGGTGCAGAGTCTGAATGGACCGATGTAGAAACAAGGTGTTCTGTGGC
   TGTGGAGATGAGAGCAGGATCCCAGCTGGGACCTGGATATCAGCATCACGCACAACCCAAGCGCAAAAAGCCATGAACTGACAGTC
   CCAGTACTGAAAGAACATTTTCATTTGTGTGGATGATTTCTTCGAAAGCCCATGCAGAAGCAGTGTTTCCAGGTCATCTTGTAGAACT
   CCAGCTTTGTTGAAAATCACGGACCTCAGCTACATCATACACTGACCCAGAGCAAAGCTTTCCCTATGGTTCCAAAGACAACTAGT
   ATTCAACAAACCTTGTATAGTATATGTTTTGCCATATTTAATATTAATAGCAGAGGAAGACTCCTTTTTTCATCACTGTATGAATT
   TTTTATAATGTTTTTTAAAATATATTTCATGTATACTTATAAACTAATTCACACAAGTGTTTGTCTTAGATGATTAAGGAAGACT
   ATATCTAGATCATGTCTGATTTTTATTGTGACTTCTCCAGCCCGGTCTGAATTTCTTAAGGTTTTATAAACAAATGCTGCTATT
   TATTAGCTGCAAGAATGCACTTTAGAACTATTTGACAATTCAGCTTTCAAAATAAAGATGAAATGACTGGCCAATAATAACCAT
   TTTAGGAAGGTGTTTTGAATTCTGTATGTATATATTCACTTTCTGACATTTAGATATGCCAAAAGAATTAAAATCAAAAGCACTAA
   GAAATAAAAAAAAAAAAAAAAAAA

93 ACGGATTGTATATTGTTTTATTTTTATTTAGAAGTAGAGAATACAGTAATAGTGAGGCAGGAGAACAGGGAATTAGGATAGCCAGG
   GGTAGGGGCATAAGCAAAGGAATAGCAGGTGCAGCCAGTTTGCATATACAAGAGAACAGCAGGTGCAGCCGATTCTAGGCAAGATC
   AGGCAGCATGAGGCCACATCCTCATGCCTTTATCAGTCGGCGAATACTGTAAGAGATTAAGAGGATCGTTCCAATAATACCAGCCA
```

TABLE 1-continued

Sequences Table. First column: SEQ ID No. Second column: corresponding mRNA sequence. For the 3 different groups, see explanation in the text.

| | |
|---|---|
| | TCACACACTAAATAATGAGTATTACACTACAGGAGCTGGTACAGTGANAGANTGGACTAAGTTGTCCAGTTTCTCCATTTGCATGT<br>GATGAGATGTACTCTTTGTGACTGAGAAGAGGTTGAGTGTGCATGCACCTCAGTGTACTTAATGCTGATATGTCACTAGTTCTGAC<br>AATAGTAATCGAAGATTATTGTTC |
| 94 | TTTTTTTTTTTTTTTTTGCAGACAGTAAATCAATTTTATTTGTGTTCACAGAACATACTAGGCGATCTCGACAGTCGCTCCGTGA<br>CAGCCCACCAACCCCCAACCCTCTACCTCGCAGCCACCCTAAAGGCGACTTCAAGAAGATGGAAGGATCTCACGGATCTCATTCCT<br>AATGGTCCGCCGAAGTCTCACACAGTAGACAGACGGAGTTGAGATGCTGGAGGATGCAGTCACCTCCTAAACTTACGACCCACCAC<br>CAGACTTCATCCCAGCCGGGACGTCCTCCCCCACCCGAGTCCTCCCCATTTCTTCTCCTACTTTGCCGCAGTTCCAGGTGTCCTGC<br>TTCCACCAGTCCCACAAAGCTCAATAAATACCAAGAGACCTGCATTTACAGCAGAGGGAACATCTCACACCCTTGCATAAGTTAAA<br>ATAAATATTACGTACACATCTCCATCACCTAGGAGGACGTACATAAATACATATAAATATTAATTGAGGAGCAATAAGAAATAAAT<br>TAACGACGCTCTCCTTCCCACCGGGCCTAGCCCCAGCTGGGCTGTGCCTCGGTCTCTATGCGCCTCGGTCTCTGTGCGCCTCGGTC<br>CCGCCTCAAGCACGGGTGGCGTCTCCGCTGTAGTGTTCTGAGTT |
| 95 | GTCTCCTCCAAGATGGCGAGCGGCGGCACGGGGGGTGTCAGTGTACCTGCGCTGTGGAGTGAAGTGAACCGGTATGGCCAGAACGG<br>CGACTTCACGCGCGCTCTCAAGACCGTCAATAAGATACTACAGATCAACAAAGATGACGTAACTGCCCTGCATTGTAAAGTGGTAT<br>GCCTTATCCAGAATGGAAGTTTCAAGGAAGCTTTGAATGTCATCAATACTCACACCAAAGTGTTAGCCAATAACTCTCTCTCCTTT<br>GAAAAGGCATATTGCGAGTACAGGCTGAACAGAATTGAGAATGCCTTGAAGACAATAGAAAGTGCCAACCAGCAGACAGACAAACT<br>GAAGGAGCTTTATGGACAAGTGTTATACCGTTTGGAACGCTATGATGAATGCTTAGCAGTGTATAGAGATCTCGTCCGGAACTCCC<br>AAGATGATTATGATGAGGAGAGGAAAACAAACCTTTCAGCAGTTGTTGCAGCTCAAAGCAATTGGGAAAAAGTGGTTCCAGAGAAC<br>CTGGGCCTCCAAGAAGGCACACATGAGCTGTGCTACAACACTGCATGTGCACTGATAGGCCAAGGCCAGCTGAACCAGGCCATGAA<br>AATCCTACAAGAAGCTGAAGATCTTTGCCGCCGTTCATTATCAGAAGACACTGATGGGACTGAGGAAGACCCACAGGCAGAACTGG<br>CCATCATTCATGGTCAGATGGCTTATATTCTGCAGCTTCAGGGTCGAACAGAGGGAGGCTTTGCAACTTTACAATCAAATAATAAA<br>CTAAAACCAACAGATGTGGGATTACTAGCTGTAATTGCAAATAACATCATTACCATTAACAAGGACCAAAATGTCTTTGACTCCAA<br>GAAGAAAGTGAAATTAACCAATGCGGAAGGAGTAGAGTTTAAGCTTTCCAAGAAACAACTACAAGCTATAGAATTTAACAAAGCTT<br>TACTTGCTATGTACACAAACCAGGCTGAACAATGCCGCAAAATATCTGCCAGTTTACAGTCCCAAAGTCCCGAGCATCTCTTACCT<br>GTGTTAATCCAAGCTGCCCAGCTCTGCCGTGAAAAGCAGCACACAAAAGCAATAGAGCTGCTTCAGGAATTTTCAGATCAGCATCC<br>AGAAATGCAGCTGAAATTAAGCTGACCATGGCACAGTTGAAAATTTCTCAAGGTAATATTTCTAAAGCATGTCTAATATTGAGAA<br>GCATAGAGGAGTTAAAGCATAAACCAGGCATGGTATCTGCATTAGTTACCATGTATAGCCATGAAGAAGATATTGATAGTGCCATT<br>GAGGTCTTCACACAAGCTATCCAGTGGTATCAAAACCATCAGCCAAAATCTCCTGCTCATTTGTCCTTGATAAGAGAAGCTGCAAA<br>CTTCAAACTCAAATATGGGCGGAAGAAGGAGGCAATTAGTGACCTACAACAGCTGTGGAACAAAATCCAAAAGATATTCACACCC<br>TGGCACAGCTTATTTCTGCTTACTCACTTGTAGATCCAGAGAAAGCCAAAGCTCTTAGTAAACACTTGCCATCGTCAGATAGTATG<br>TCTCTAAAAGTAGATGTTGAGGCTCTTGAAAATTCTGCTGGTGCTACATACATTCGGAAGAAGGGTGGAAAAGTTACTGGAGATAG<br>TCAACCAAAGGAACAAGGACAGGGAGATTTGAAAAAGAAGAAAAAGAAAAAGAAGGGAAAATTGCCTAAGAATTATGACCCAAAAG<br>TTACCCCAGATCCAGAAAGATGGCTGCCAATGCGAGAACGTTCTTACTACCGGGGAAGAAAGAAGGGTAAAAAGAAGGATCAGATT<br>GGAAAAGGGACCCAGGGAGCAACTGCAGGAGCTTCATCTGAAGTGGATGCCAGTAAAACTGTGAGCAGCCCACCCACCTCCCCAAG<br>ACCTGGCAGTGCTGCAACAGTATCTGCCTCTACAAGTAACATCATACCCCCAAGACACCAGAAACCTGCAGGGGCTCCAGCAACAA<br>AAAAGAAACAGCAACAGAAAAGAAGAAAGGTGGAAAAGGTGGCTGGTGATGAGAATATTCTTGTTGCAGGCTGTTTTTAAACTAG<br>TGTCAGTGACACTAGGAATATAATAAAGGTAACACAGCAAGAAGCACAGACTACTCCCTCTTCATCTCCATATTTTCATAATTTC<br>TTGTGTTTCAAATAGGGAAACATCTTCCTCAAAGTCTGCCTAGTGAGATACAGGCCTACTGGTTGCCTCATAGCTTTGTACAGATTA<br>TGAGGACTGAAAATAATTGGGCATTTACCCATCTTGGTATCTGTTGTATCCTTTATCTGTGTGTGCTGATTTGATCTTTTTCAGT<br>TTCACATACCTTATCTAAGGTTTCCCAGGATTTAAACAGAAACTACTTCTATGATTTCAGCTGGAGTCTGAAGATACTTGTTTCTG<br>TTCAAGTCCCACTTTAAATTATGTCTTAGGAGACTGAAAGTGGACATTCCTAAATATCTGCTTAGAAATATCATGT<br>GATAAAGAGGGACCTTCTTAATACACTGATGTTCTTCACTAAATGGATGGCCACAAGAAAAATAAAGTAAATGTCTTAAATAATTT<br>AACCATAAATTTTCTGTCATGTGATCCCTGGCATCTGGGATACTTTCCATGTTTATATATATATATATGTATATATATATACGA<br>TATATATATATATAAACTGAAATATATATATATGGCTCCTTTGTGCCCCATGTCATTTTCAGATTATGGTAGCATGCTGATACA<br>GCACCATGAAAGAACTCAAGGAAAATATATCAATGTAAGAAGTTCACTCTTAGACCCAGTTGTTGAGGTCGACGATGGGTTTGGA<br>CTGTCTCAATCAGAAAGATTAATGACTGTTATCAAGAACATGAACATTGGCTTCCTCCATAGAGAAGAAATCAGTATCTGAGTTGC<br>ATACCAGGCAGTATTAAAATCTAACAGGTCTGTTTGGCCCATTGATAGATACTCAAATGGTGTCTCCTTCTGGTTATGGATTTTGA<br>CCATTGATTACCTTTCTCAATGTAATGAAGTATTTTACAGTCAATTTGTGGTGTAAATGTTGCTCTTGTCTTTCCTTGCTTACAAA<br>CTACTTTCACATTGAACAGCTGTGAGACAGACATATTGAGATGCCTCCCTTGTTAGTATTCATTTTATGCTGCCAAGATATCAT<br>TTAATTTAGACTTAACAAGTATTTCCTTGTGATTATATTACTCTGTCCTTGTTAATAAAGTGCTGCTGTGTTTGACTCTGAACATA<br>CTACCAAAACTTCTTCAAAGAGTTTTTATGAAAGACTTTCCTCCTTTACAAGAAAGAAATGGGGTGCTGCCTTTCTGTTTAGTAA<br>AAGCAGAATTTGCAGTGGCATCTAAAGAGATCTTTTTTAAATAAAAATTATGTATTGTGGCATAATCCTTTTTTGAGCTCTACAG<br>AGAACAGTCTTTTGGTAATAGTGGCAGGTATTTATTCCTTCTGAATATATACCCCATTATAGGAATAACTGTTACTTATTTAGGTT<br>CCATCATTGAAAATTTTGACCCAAGGCACAGCAGTGAAATTTATAGTTCTCAATTTAGTTGTCATTATTGACAGGCATTGGTATTA<br>TTAGTCATTGCTAAGCAACTAAAACTTCATCAGTTCAAATAAGTTTTAATTGTCAAATGAAGTATAAACACATGAACTTTCTAGAA<br>ATATTTCCTCTTTTGGATAGGTCTTTAACCAGTTCATATATATACTTTGTCAAATATATGGATGTGTATGTGTACATTTATAAGAA<br>CCAGTATGGATACATCCATTCACTGTGGTACATTTTAAAATAAAATATTTTAGCAGTGAATATGGAAA |
| 96 | CTGGAAGGTTCTCAGGTCTTTATTTGCTCTCTCAACTTCCAGGAATTGACTTATTTAATTAATCCATCAACCCTTCATAGCAAATA<br>TTTGAGAAAACAAATTTATATTCAGGTTCTTAACTTCATTAGGGAAGTAAGAAGTTGCAGCTCAGCGCACCATGAAGTTGAGACAG<br>AGATGGAGACATCCAGCCCACTTCTCTGGAACAGGAAAGATGATCGGGGAGGGAACACAGGTCAGTGTGGGGACAGGGGTCACGGT<br>GGACACGGGGTGGGCTGTCTCTCCACCTCCTCACATTATGCTAACAGGAACGCAGACACATTCAGATGCCTTTGCAGAAAGAGAT<br>GCCAGACGTCTTGAAGTCACAAAGGAGAGGTGTGAAGAAATCCTGCATCTCAGTCCCACACAGGCAGCTGTCTCAGGCTTTACAAG<br>CGATGAGAGA |
| 97 | GGTGGCGAATTCCGACGAGGGGCGGGCAGCAGCTGCGCTGCGACTGCTCTGGAAGGAGAGGACGGGGCACAAACCCTGACCATGAC<br>CCCCCACAGGCTGCTGCCACCGCTGCTGCTGCTGCTAGCTCTGCTGCTCGCTGCCAGCCCAGGAGGCGCCTTGGCGCGGTGCCCAG<br>GCTGCGGGCAAGGGGTGCAGGCGGGTTGTCCAGGGGGCTGCGTGGAGGAGGAGGATGGGGGTCNNCANCCNNAGGCTGNNCCCAA<br>CCTGACGCCCTGCTCACGAGGGACGGACCAACGCCACTCTCCCGCACCCAACCCCGCGCTGCTGCTCCCGCTTCCCCGTGTCCCCT<br>CCCGTCCGGCGCTCCCCGCTCCCGCGCTCCCGTGTCTTCTGCCATGATATTGCCCCATCCCCAACCCTAACAGCCTCACTCCG<br>CAGACCCACCCACACCCCCAAGTCCTATTCCGCCCTCCCCCTATCTATGACCACACCCCCACTCCACTACCACCCCCACCCGTCA<br>GTGCACATCCCCCACCAACCCGCCGAGCAAACCTCCCTATCCACCCCATACACCCGTTCGCAATACCCCACACCCCCCTCCCCTC<br>CCCCCGTCCTGCCCTCCCTCCGCCCACCTTCTCCTTAACCACGCTAGCCTACTCCACACGGCACTCCGACAACGCCACCCCGCCCC<br>CATCCGACCAATCGCCCCCTATGCCACCGTTCTTCTCCAATCGAACCATTGCGGCCCGTCGACCCTCCCTATCTCACAGCGCTACC<br>ATGTACCTCTCTTCGTCTCCTGCTACCCACCACCACTATTCCACTACCCCTCCACCTGATGTACAATCCACCCTCCGCTTCCCCCG |

TABLE 1-continued

Sequences Table. First column: SEQ ID No. Second
column: corresponding mRNA sequence. For the 3 different
groups, see explanation in the text.

TCCCCTACTCTCCCCGTATGCCGCTCATCCCGCGCATACCGATTGCGTATCAGATGACCACTGCACAATCACAAGACCCTGGCGCA
TCCGCACCATTTATCGCTGCCCCGACTGTCTGCCATCCCACAACCACACACTTATACGCTCACCGCCCATATACACACACTGTCAG
AGCCGTGCAACCGTNCTGTTCCGACGAGCCAGGACACACCCCACTTCTCCTTCGCCCCCGNTGCCTCCTGTACTACCCTTNTGAAC
ACAATACTTATCGGCACCATCTACACACGATTTTAAAACATNGACATAATCATGGGCGCGCGTAAGATCACGACCTCCACANCCCC
CACCCATACAACTCCGAATCACCCCCCGCCCGGACGATATATGNNCTGGTATCGCACGGCGTAGAGCGAGAACCGATTCGCGACGC
GATGAGAAGATCTACACAAAAAGTGACCACCATACACCACGCGCGAGTGCACCACTACCCCCGCGCGTCACACAATGACTGCGTCG
CCTCTCATCTCCTAACCCACATGTCATCCGTTCCGGAATAGCGGCCCACTCCCGGCGGAGAGGGACGCATTACTCTTTCCGTCACC
CGAACCCCATTTGAGCCCCCCCACCAGGACAAATNGGGAGCAACCCCGCCCCGCCCCAATTGGCATATAATATATACACTGCCGCC
AAACCAGGCATTGTATNTAATGCTAACAGATACTAGCGTTTACTAAAGATACGGCGCCCGACAAA

98 TTTTTTTTTAGGCAGAATCAACCCATGCTTTTATTTTCATTGCATATAAAAATTTCATATGAAGGTATTGATGTACAGTACTATCC
CCGTGGGCTGTAAGAGAGGCTAAGAAACCACTAAAAGAATAATCATTTGTAATTCTCACACACAATTTACCACTCTGAAATATAT
CCAAAGAAATAAAAACAACTCAAATCAGTTAAGGATGTTTTTGTAATTATAGTGTCCCCTTTGTACTGTTTAAAACAAAAGTAATC
AAATTCCTTTGGGCCAGGGCTGCTAAAATCTACAGTTTGTGTCAAAAAATAAAATAAAATAAAATAAAATAGGCTCATTTTTCCTA
GAAAAAGAATCTTTCCTTTCACTGAAAAGCCACATGATTCAAGGGCTGGGCAAGTACTGGGAGGATGTTTCCATATAATCCATTAT
AAATGTTTC

99 AGCGGGGCGGGGCGCCAGCGCTGCCTTTTCTCCTGCCGGGTAGTTTCGCTTTCCTGCGCAGAGTCTGCGGAGGGGCTCGGCTGCAC
CGGGGGGATCGCGCCTGGCAGACCCCAGACCGAGCAGAGGCGACCCAGCGCGCTCGGGAGAGGCTGCACCGCCGCGCCCCCGCCTA
GCCCTTCCGGATCCTGCGCGCAGAAAAGTTTCATTTGCTGTATGCCATCCTCGAGAGCTGTCTAGGTTAACGTTCGCACTCTGTGT
ATATAACCTCGACAGTCTTGGCACCTAACGTGCTGTGCGTAGCTGCTCCTTTGGTTGAATCCCCAGGCCCTTGTTGGGGCACAAGG
TGGCAGGATGTCTCAGTGGTACGAACTTCAGCAGCTTGACTCAAAATTCCTGGAGCAGGTTCACCAGCTTTATGATGACAGTTTTC
CCATGGAAATCAGACAGTACCTGGCACAGTGGTTAGAAAAGCAAGACTGGGAGCACGCTGCCAATGATGTTTCATTTGCCACCATC
CGTTTTCATGACCTCCTGTCACAGCTGGATGATCAATATAGTCGCTTTTCTTTGGAGAATAACTTCTTGCTACAGCATAACATAAG
GAAAAGCAAGCGTAATCTTCAGGATAATTTTCAGGAAGACCCAATCAGATGTCTATGATCATTTACAGCTGTCTGAAGGAAGAAA
GGAAAATTCTGGAAAAACGCCCAGAGATTTAATCAGGCTCAGTCGGGGAATATTCAGAGCACAGTGATGTTAGACAAACAGAAAGAG
CTTGACAGTAAAGTCAGAAATGTGAAGGACAAGGTTATGTGTATAGAGCATGAAATCAAGAGCCTGGAAGATTTACAAGATGAATA
TGACTTCAAATGCAAAACCTTGCAGAACAGAGAACACGAGACCAATGGTGTGGCAAAGAGTGATCAGAAACAAGAACAGCTGTTAC
TCAAGAAGATGTATTTAATGCTTGACAATAAGAGAAAGGAAGTAGTTCACAAAATAATAGAGTTGCTGAATGTCACTGAACTTACC
CAGAATGCCCTGATTAATGATGAACTAGTGGAGTGGAAGCGGAGACAGCAGAGCGCCTGTATTGGGGGGCCGCCCAATGCTTGCTT
GGATCAGCTGCAGAACTGGTTCACTATAGTTGCGGAGAGTCTGCAGCAAGTTCGGCAGCAGCTTAAAAAGTTGGAGGAATTGGAAC
AGAAATACACCTACGAACATGACCCTATCACAAAAAACAAACAAGTGTTATGGGACCGCACCTTCAGTCTTTTCCAGCAGCTCATT
CAGAGCTCGTTTGTGGTGGAAAGACAGCCCTGCATGCCAACGCACCCTCAGAGGCCGCTGGTCTTGAAGACAGGGGTCCAGTTCAC
TGTGAAGTTGAGACTGTTGGTGAAATTGCAAGAGCTGAATTATAATTTGAAAGTCAAAGTCTTATTTGATAAAGATGTGAATGAGA
GAAATACAGTAAAAGGATTTAGGAAGTTCAACATTTTGGGCACGCACACAAAAGTGATGAACATGGAGGAGTCCACCAATGGCAGT
CTGGCGGCTGAATTTCGGCACCTGCAATTGAAAGAACAGAAAAATGCTGGCACCAGAACGAATGAGGGTCCTCTCATCGTTACTGA
AGAGCTTCACTCCCTTAGTTTTGAAACCCAATTGTGCCAGCCTGGTTTGGTAATTGACCTCGAGACGACCTCTCTGCCCGTTGTGG
TGATCTCCAACGTCAGCCAGCTCCCGAGCGGTTGGGCCTCCATCCTTTGGTACACAGCATGCTGGTGGCGGAACCCAGGAATCTGTC
TTCTTCCTGACTCCACCATGTGCACGATGGGCTCAGCTTTCAGAAGTGCTGAGTTGGCAGTTTTCTTCTGTCACCAAAAGAGGTCT
CAATGTGGACCAGCTGAACATGTTGGGAGAGAAGCTTCTTGGTCCTAACGCCAGCCCCGATGGTCTCATTCCGTGGACGAGGTTTT
GTAAGGAAAATATAAATGATAAAAATTTTCCCTTCTGGCTTTGGATTGAAAGCATCCTAGAACTCATTAAAAAACACCTGCTCCCT
CTCTGGAATGATGGGTGCATCATGGGCTTCATCAGCAAGGAGCCAGGCTGCCCTGTTGAAGGACCAGCAGCCGGGGACCTTCCT
GCTGCGGTTCAGTGAGAGCTCCCGGGAAGGGGCCATCACATTCACATGGGTGGAGCGGTCCCAGAACGGAGGCGAACCTGACTTCC
ATGCGGTTGAACCCTACACGAAGAAAGAACTTTCTGCTGTTACTTTCCCTGACATCATTCGCAATTACAAAGTCATGGCTGCTGAG
AATATTCCTGAGAATCCCCTGAAGTATCTGTATCCAAATATTGACAAAGACCATGCCTTTGGAAAGTATTACTCCAGGCCAAAGGA
AGCACCAGAGCCAATGAACTTGATGGCCCTAAAGGAACTTGGATATATATCAAGACTGATTTGTCTGTCTGAAGTTCACCCTT
CTAGACTTCAGACCACAGACAACCTGCTCCCCATGTCTCCTGAGGAGTTTGACGAGGTGTCTCGGATAGTGGGCTCTGTAGAATTC
GACAGTATGATGAACACAGTATAGAGCATGAATTTTTTTCATCTTCTCTGGCGACAGTTTTCCTTCTCATCTGTGATTCCCTCCTG
CTACTCTGTTCCTTCACATCCTGTGTTTCTAGGGAAATGAAAGAAAGGCCAGCAAATTCGCTGCAACCTGTTGATAGCAAGTGAAT
TTTTCTCTAACTCAGAAACATCAGTTACTCTGAAGGGCATCATGCATCTTACTGAAGGTAAAATTGAAAGGCATTCTCTGAAGAGT
GGGTTTCACAAGTGAAAAACATCCAGATACACCCAAAGTATCAGGACGAGAATGAGGGTCCTTTGGGAAAGGAGAAGTTAAGCAAC
ATCTAGCAAATGTTATGCATAAAGTCAGTGCCCAACTGTTATAGGTTGTTGGATAAATCAGTGGTTATTTAGGGAACTGCTTGACG
TAGGAACGGTAAATTTCTGTGGGAGAATTCTTACATGTTTTCTTTGCTTTAAGTGTAACTGGCAGTTTTCCATTGGTTTACCTGTG
AAATAGTTCAAAGCCAAGTTTATATACAATTATATCAGTCCTCTTTCAAAGGATCATCATGGATCTGGTAGGGGGAAAATGTGT
ATTTTATTACATCTTTCACATTGGCTATTTAAAGACAAAGACAAATTCTGTTTCTTGAGAAGAGAATATTAGCTTTACTGTTTGTT
ATGGCTTAATGACACTAGCTAATATCAATAGAAGGATGTACATTTCCAAATTCACAAGTTGTGTTTGATATCCAAAGCTGAATACA
TTCTGCTTTCATCTTGGTCACATACAATTATTTTTACAGTTCTCCCAAGGGAGTTAGGCTATTCACAACCACTCATTCAAAAGTTG
AAATTAACCATAGATGTAGATAAACTCAGAAATTTAATTCATGTTTCTTAAATGGGCTACTTTGTCCTTTTTGTTATTAGGGTGGT
ATTTAGTCTATTAGCCACAAAATTGGGAAAGGAGTAGAAAAAGCAGTAACTGACACCTTGAACAACTTGAATAATACCAGAGATAATATGAGA
ATCAGATCATTTCAAAACTCATTTCCTATGTAACTGCATTGAGAACTGCATATGTTTCGCTGATATATGTGTTTTCACATTTGCG
AATGGTTCCATTCTCTCCTGTACTTTTTCCAGACACTTTTTTGAGTGGATGATGTTTCGTGAAGTATACTGTATTTTTACCTTT
TTCCTTCCTTATCACTGACACAAAAAGTAGATTAAGAGATGGGTTTGACAAGGTTCTTCCCTTTTACATACTGCTGTCTATGTGGC
TGTATCTTGTTTTTCCACTACTGCTACCACAACTATATTATCATGCAAATGCTGTATTCTTTCTTTGGTGGAGATAAAGATTTCTTG
AGTTTTGTTTAAAATTAAAGCTAAAGTATCTGTATTGCATTAAATATAATATGCACACAGTGCTTTCCGTGGCACTGCATACAAT
CTGAGGCCTCCTCTCAGTTTTTATATAGATGGCGAGAACCTAAGTTTCAGTTGATTTTACAATTGAAATGACTAAAAACAAAG
AAGACAACATTAAAACAATATTGTTTCTA

100 GGGAATAGCAGAATAGGAGCAAGCCAGCACTAGTCAGCTAACTAAGTGACTCAACCAAGGCCTTTTTTCCTTGTTATCTTTGCAGA
TACTTCATTTTCTTAGCGTTTCTGGAGATTACAACATCCTGCGGTTCCGTTTCTGGGAACTTTACTGATTTATCTCCCCCCTCACA
CAAATAAGCATTGATTCCTGCATTTCTGAAGATCTCAAGATCTGGACTACTGTTGAAAAAATTTCCAGTGAGGCTCACTTATGTCT
GTAAAGATGGGAAAAAAATACAAGACACATTGTTCTACTAAAAGGATTAGAGGTCATCAATGATTATCATTTTAGAATGGTTAAGTC
CTTACTGAGCAACGATTTAAAACTTAATTTAAAAATGAGAGAAGAGTATGACAAAATTCAGATTGCTGACTTGATGGAAGAAAGT
TCCGAGGTGATGCTGGTTTGGGCAAACTAATAAAAATTTTCGAAGATATACCAACGCTTGAAGACCTGGCTGAAACTCTTAAAAAA
GAAAAGTTAAAAGTAAAAGGACCAGCCCTATCAAGAAAGAGGAAGAAGGAAGTGCATGCTACTTCACCTGCACCCTCCACAAGCAG
CACTGTCAAAACTGAAGGAGCAGAGGCAACTCCTGGAGCTCAGAAAAGAAAAAAATCAACCAAAGAAAAGGCTGGACCCAAAGGGA
GTAAGGTGTCCGAGGAACAGACTCAGCCTCCCTCTCCTGCAGGAGCCGGCATGTCCACAGCCATGGGCCGTTCCCCATCTCCCAAG

TABLE 1-continued

Sequences Table. First column: SEQ ID No. Second column: corresponding mRNA sequence. For the 3 different groups, see explanation in the text.

```
    ACCTCATTGTCAGCTCCACCCAACAGTTCTTCAACTGAGAACCCGAAAACAGTGGCCAAATGTCAGGTAACTCCCAGAAGAAATGT
    TCTCCAAAAACGCCCAGTGATAGTGAAGGTACTGAGTACAACAAAGCCATTTGAATATGAGACCCCAGAAATGGAGAAAAAAATAA
    TGTTTCATGCTACAGTGGCTACACAGACACAGTTCTTCCATGTGAAGGTTTTAAACACCAGCTTGAAGGAGAAATTCAATGGAAAG
    AAAATCATCATCATATCAGATTATTTGGAATATGATAGTCTCTAGAGGTCAATGAAGAATCTACTGTATCTGAAGCTGGTCCTAA
    CCAAACGTTTGAGGTTCCAAATAAAATCATCAACAGAGCAAAGGAAACTCTGAAGATTGATATTCTTCACAAACAAGCTTCAGGAA
    ATATTGTATATGGGGTATTTATGCTACATAAGAAAACAGTAAATCAGAAGACCACAATCTACGAAATTCAGGATGATAGAGGAAAA
    ATGGATGTAGTGGGGACAGGACAATGTCACAATATCCCCTGTGAAGAAGGAGATAAGCTCCAGCTTTTCTGCTTTCGACTTAGAAA
    AAAGAACCAGATGTCAAAACTGATTTCAGAAATGCATAGTTTTATCCAGATAAAGAAAAAAACAAACCCGAGAAACAATGACCCCA
    AGAGCATGAAGCTACCCCAGGAACAGCGTCAGCTTCCATATCCTTCAGAGGCCAGCACAACCTTCCCTGAGAGCCATCTTCGGACT
    CCTCAGATGCCACCAACAACTCCATCCAGCAGTTTCTTCACCAAGAAAAGTGAAGACACAATCTCCAAAATGAATGACTTCATGAG
    GATGCAGATACTGAAGGAAGGGAGTCATTTTCCAGGACCGTTCATGACCAGCATAGGCCCAGCTGAGAGCCATCCCCACACTCCTC
    AGATGCCTCCATCAACACCAAGCAGCAGTTTCTTAACCACGTTGAAACCAAGACTGAAGACTGAACCTGAAGAAGTTTCCATAGAA
    GACAGTGCCCAGAGTGACCTCAAAGAAGTGATGGTGCTGAACGCAACAGAATCATTTGTATATGAGCCCAAAGAGCAGAAGAAAAT
    GTTTCATGCCACAGTGGCAACTGAGAATGAAGTCTTCCGAGTGAAGGTTTTTAATATTGACCTAAAGGAGAAGTTCACCCCAAAGA
    AGATCATTGCCATAGCAAATTATGTTTGCCGCAATGGGTTCCTGGAGGTATATCCTTTCACACTTGTGGCTGATGTGAATGCTGAC
    CGAAACATGGAGATCCCAAAAGGATTGATTAGAAGTGCCAGCGTAACTCCTAAAATCAATCAGCTTTGCTCACAAACTAAAGGAAG
    TTTTGTGAATGGGGTGTTTGAGGTACATAAGGTAAGCCCACACCATTGTTTTATAAAATTTCTCCTGCAACCTCCAATTTTTAAAG
    TCTTAACTTGTCAACTGGAGTTTGGTCAACTTACTCAACACAGAAAATCAACCCCTTCACCCTTCCCCAGCACTAGAGATAATTG
    AATAGAGTTCATTTCAGGATATGGGGTACGTTATATTGTAACATTCCTCTTCTTAAGGTATCATCATGCAAGTTATTTAGACAGTC
    ACTAGGAAACTTGGCATTTTATTAGTTTTGATGATCTATTCAGAGCCACCCTTGTCCAGGACAGTGCAGAGTTTATATCAACACAC
    ATATCCTTAGGATTTTGTTTCTTTGAGTTCTTCTCCATCTGTATCATGACAACTTAATTTAATTGTGAATAAAAGAGTTGCTCTC
    CCAAGCCTGAATCCTGATTGTGACAACCAGAGTAAGAAATAAAATAGACTACTCTGCTTTAGAATGCAGCTATGTCTAACAGTTAG
    CTAGAATTCTGATCATTTGGACTCCAAAGTTTCTTGCCTCTTCTCATTCATTAATTCATCAGGAGACTGTAGAGCAACTAACTTCT
    GCATTAAATAATAAGAGAAATACGAAGCAAAAGACTAAAAAAGTCACGTAGCTTAACTGCTCAATTTATAAATGGGGCAATAAAA
    TGCAAAAAAAAGAAAAAAAGCTTGGTGAATTCTTAGGCTTACAGTGTGCCTTTCAGTCTCTACACATCATGTAAATATTATGCTT
    AGCTGATTTAACTTCTTGTTTGAAGTACTGTTTCATACTCCATTATACATGTCTTCTAGGGTGGCTTACTTTTAATTGTGCTGTTT
    TCTCTACACTCAGTTTAAATGACTGTACATATATATGTGGTTGGAGAGTTAATGAATAATGAGCTACAAACCAGAACAATGTGACT
    AGATAGATAGGATGATCTAGAATTGAGAACTGGCAGATTGGGAAAAGAGTGGCTATATGGAGAAAGAAAGAAAGTAGTTCCATATT
    GAAATAACAGTCTACTTAATGAGGACCGTTGCAACATTCTTTCTCAAACTTACAAAGTGCCATAAAAAGCCTCTATTCTCTGCTCT
    TGGGCAGGTGTGAAAGAAACCTACCAAATTAATCAGATTTTTCTGTATCCAGGCTCCTTAAAAAATCCCAGCTGTGCTGATGTGGA
    AACAGGAAGAATTAGGAAGAGGTTCTAAAAACAGCAGAAAAGGTTGAATGACAACCCTACTTGCCTAAATGAGGAATGTCTTTCCT
    GGAGTTGAAAGGCAGGATTCAAAGACCAAGTATCTTAAGCTATTTGGTACCTGTTATTCAGGACCTACAGCTCTGTTTACTCTATC
    AAAGACCAAAAGTTTCCAGAAACACCCTGTATTTCTCATAGATTTGAAAATTATTGATCCAGTTTCAGAAGATAAGTGTTAATTTT
    CTTTTGCAGAAAAATGTAAGGGGTGAATTCACTTATTATGAAATACAAGATAATACAGGGAAGATGGAAGTGGTGGTGCATGGACG
    ACTGACCACAATCAACTGTGAGGAAGGAGATAAACTGAAACTCACCTGCTTTGAATTGGCACCGAAAAGTGGGAATACCGGGGAGT
    TGAGATCTGTAATTCATAGTCACATCAAGGTCATCAAGACCAGGAAAAACAAGAAAGACATACTCAATCCTGATTCCAAGTATGGA
    AACTTCACCAGACTTTTTCTTCTAAAATCTGGATGTCATTGACGATAATGTTTATGGAGATAAGGTCTAAGTGCCTAAAAAAATGT
    ACATATACCTGGTTGAAATACAACACTATACATACACACCACCATATATACTAGCTGTTAATCCTATGGAATGGGGTATTGGGAGT
    GCTTTTTTAATTTTTCATAGTTTTTTTTAATAAAATGGCATATTTTGCATCTACAACTTCTATAATTTGAAAAATAAATAAACA
    TTATCTTTTTGTGAAAAAAAAA
101 GAGTTGGAAGAGGCGAGTCCGGTCTCAAAATGGAGGGCCATGATCCAAAGGAACCAGAGCAGTTGAGAAAACTGTTTATTGGTGGT
    CTGAGCTTTGAAACTACAGATGATAGTTTACGAGAACATTTTGAGAAATGGGGCACACTCACAGATTGTGTGGTAATGAGAGACCC
    CCAAACAAAACGTTCCAGGGGCTTTGGTTTTGTGACTTATTCTTGTGTTGAAGAGGTGGATGCAGCAATGTGTGCTCGACCACACA
    AGGTTGATGGGCGTGTAGTGGAACCAAAGAGAGCTGTTTCTAGAGAGGATTCTGTAAAGCCTGGTGCCCATCTAACAGTGAAGAAA
    ATTTTTGTTGGTGGTATTAAAGAAGATACAGAAGAATATAATTTGAGAGACTACTTTGAAAAGTATGGCAAGATTGAAACCATAGA
    AGTTATGGAAGACAGGCAGAGTGGAAAAAAGAGAGGATTTGCTTTTGTAACTTTTGATGATCATGATACAGTTGATAAAATTGTTG
    TTCAGAAATACCACACTATTAATGGGCATAATTGTGAAGTGAAAAATGCCCTTTCTAAACAAGAGATGCAGTCTGCTGGATCACAG
    AGAGGTCGTGGAGGTGGATCTGGCAATTTTATGGGTCGCGGAGGGAACTTTGGATATGGTGGAGGTGGAGGATATGATGGTTACAA
    TGAAGGAGGAAATTTTGGCGGTGGTAACTATGGTGGTGGTGGGAACTATAATGATTTTGGAAATTATAGTGGACAACAGCAATCAA
    ATTATGGACCCATGAAAGGGGGCAGTTTTGGTGGAAGAAGCTCGGGCAGTCCCTATGGTGGTGGTTATGGATCTGGTGGTGGAAGT
    GGTGGATATGGTAGCAGAAGGTTCTAAAAACAGCAGAAAAGGTTGAATGACAACCCTACTTGCCTAAATGAGGAATGTCTTTCCT
    ACCATCTAAAATACGAAGGTTTCTGGCTGGGTAAGGTTTGTAGTTGACAGTAAAACCTGATGACACCATTTGTTTCCCTGCAAGTC
    TACATTACATATTTCACAACTTTGTCCCTCTCTAGTAGGCACATTGGAAAAATTCTTCAACTGAAAACTACCTTGGTACCATGTCC
    TACACGTTTTAAACCTTAGTTTTAAAAATTCCCCTGCGAAATAGCCATAAGTATTCATATCAAGTCAGTTGTGACTCCTTGTGTAT
    ACAATTCATTTTTGTGTCTTCAGGGTAAACTCAATTTTTGGTAAAGTGGTTTCAGCTTTTGTGAAAACCGTTTTTGTGTGTAAGC
    ATGACACACAACAGACTCAGTAAGCTGCCCATCCTCATACTAGGAAAACACCTTCAAAGGAACATTAAAAGTTACCAGGGCCAGGC
    ACAGTGGCTCACGCCTGTAATCCCAGCACTTTGGGAGGCTGAGGCAGATGGATCCCAAGTCCAGGAATTTGAGACGAGCCTGGGCA
    ACATAGTGAGAGCCTGTCAACAAAAAATAGAAAATTAGCTGGGCTTGGTGATACACATCTGTAGTCCCAGCTATTTGGGAGGCTG
    CCTTGATATCAGGCAGTCGAGGCTGCAGTGAGCTGACTGCCCCACTGTATTCCAGCCTGGGTGACCCCATCTCAAAGAAGAAAAGT
    TACCAGATGTCATGGGTAAAGGTTGGTCTTCAAGTGGCCTCATAAGTTGTCTTGCATTTAAATTCAGGGAACTCATTGGACCAATA
    GGTTACATTTTCGTTCCTTTTTTGTTTTGGTTCATCTGTTAAGCAGTGGGGGCCTAATTACTGCTCCTTTGTAAAAACACATTTTC
    CCAAAGAACACTGAATTACCGTTCAAACTGGTTGTTGATGGGTAATAAGGGCTGTTTTGCTGCCCCAAAAGGGCTTAACAATTTA
    GGCGGATAGTTTACTTAAAAAAAAAAAATCCTTTGGAGACATACTGAAAATGCAAACTAGTTTCTAAATTATCAATTCCCTACATGA
    AGAAGCAGTTTGCCAGAGTTTAGTCTCAGAAAATGACTGGTTGGCTCTATTTAAATCAGAACCCAATTTCTACGCGTGTTGAATAA
    GGTAACAGCCTTTGATGAATTTCCTTCACAACATGGTTTTAGTGAAGCAAACATTTTTTTTTAAGGGCATTGTTCTTTCTAGTTT
    ATTTCTTTTTATGAAATAAAATTATTTTATTTAAACAGTTCCATTGTCGTTTCTGAAAACTACAGTATTCTCAGAAGTTGTAGCAG
    CAGTAAAAAAAAAAAAGTTGTTCTATAAGTGATTGGGGCAGATTTAACTGATTTTGTTAAACCAATTTGTAAGTTACTGCTTCTAA
    TATTACACTTCTAAAAAGCTGAATTTATACTCATGTCCTAAAGGAGAATATGTGGTAATAAAGTATATTTGTTAAGTAACTAATTG
    AAATAGGCTTGGTTTTAAGAGTTCCAGTATATAATAATCACAAATTGAAACCTGACAGTATCTTGGGAGTTCCAGTAATGTCACAA
    ATTAGTGAATAAGCATGCCAGTGTGCAAGGGTAATGTAAGGATTGTTAGCCTATCTAAATATTCAAAATTACTTTAAACTTAAGT
    ATGTTTTCTGATTTTTAAGAATTCAGAAGTGTTCTGTAATGGATTCAGATGTTTCATTTGTAGTATAATGAAATGTTTACAGAAAG
    ATAACTTTTTCATTAAAATATTTTTAGAAAAAAAAAAAAAAAAAAAAAAAAGAAAAAAAAAAAAAAAAAAA
```

TABLE 1-continued

Sequences Table. First column: SEQ ID No. Second column: corresponding mRNA sequence. For the 3 different groups, see explanation in the text.

102 CATGTTAGGTTATTTTCTTCCTATCCTGGGGCCTTACCAATGTGTAATGCTTTCAAAGTTTCTATGAAGCCTGTGTGGATTCTATT
TTAGCTTATTTATATATTCTCATTTATTTTGAAGGATATTATACTTAATTTGGTTCAGAGTAGTCGCCAGGTTTTGCACCTGACAA
TGGCACATATTTTTGTATAACTTTTTCTAGGTCCTTACCCTTTTCTACACTTTACATTTGTACAGTGAAAGCAACTGCCAGTGGA
GGCCTGAAATGTCCAAGAAAAAAAAAAATCACACCTCTTACTGCCAGTGGTAGTGGAGTGTTTTGGTTAGAGGGACCGCAGAAAGA
CAGTGGCCAGGCTAGACAGAGCAGCACTTTGAAAAGAGCTGGGAAGATGCCTCCTAGCATAGCTGGAACAGATGTGGGAGTTGCCA
TTCAGGAACTGACTTTGTTATAGGTAGAAAATGAAAAGGCAGATGCTTACTTATTTACCTGCTATGCTTCCACCTCCAAGCCTAAC
TTAGTTTTTCTAATAGTTTTAAATTCTCTTTTTCTGTTCTAATGACACGCTCCTTTTTAATGTAGGTAAGGCTTTATACTTCTC
CTTGACCTGTAGTGGCATGAGAGTGTATAACATTTCCTAAGATGACAGGCAAAGTAGAACTAACCCTGGCACTGCCATTAGCTGGA
CCCCACCTTCTGCCATCTCTGGCCACGAAGTCACTTTCCTTGTTTGCGGCTATACCACAGTGGTGGGACTGCCCAGGGGTAAGTTG
GTCAGTGGACAGTGTTCCTCTTTTCTGAAAACTGTCTGCACAATTGCCAGCAGGCATTTGCTGGTTAAGATGCAAACAGTTTTAAA
ATTCGTCATTTTAAAACCATACTTGGCATCTAATAACTACAGTTTACCCAACCATCCACTCATCTTTTAAAAAAAAATCATTTTGA
TTCTTGCTAAGGAATAAGGTTGCATGTTTTGCAGTTGCCTAAAATTGACAACGTGGACCGTGGGTTTGGCATTACTTTGTACCTAA
AAGAGGGGGAAAGCTCCTGGCATTGCTGTAGCTGTAACCATTCCAGTGATTGTCCTTTTTTTCCCCCTACCCAACTAGATTAATAG
CATGTCCTCCATTCACTATGTAATTTCAATCCCTAAACTGCTTTAGACCTTTTCTTCAAGTCAATTGTACAAAGGCATTTATTGTA
TATTTATTCTCTGACTCCTTCAGCAGCTCAGAAGTGGAAAATGAAGCTCCTATTCAGTACTAATGGGACACCCAAACCTAATAGAT
AATGGTTTTGTGTTATTTGAGAAAACAAAAGCCAAACAGTAAATCCTCCCACTAGACATGCAGTGGTTCAAGAAGTCACTTGTGA
ATTCTAAATTACATACAAATGGAAACTAACCATATGTCTTTAATTCAGTATTAAATTTTGCTTTGGCTTGTCATGTAGAGTAGCCT
TCTCAAATTTTTGGTTTTAATTTCTGTCAATTCCATAATCATTGCATGAGCATTCACCATCACTGAATGCTGGTGCTGTCGCTCCT
AATTTTCCTTTCTTTTTAATTTATTATTATTTCTAACTTTTTTGTTTTGTTTTTAACTTGCAGTGCGAGCTTCACATAAAGCCTG
GCAAGCCAAGGATGTTCCCGCATTCACCTGCTTTTGCAGTAATATCTGTATCTCTGCCATGTGTGTTCTTTAGTTTTATTTTATTTT
ATTTTATTTTTTTACCCTTCCTCAAACACCAGTAACTATTATTAACTCGTTTTGCTGAATGTGTTGGGTGGTAGAAAATGATAGA
ACAAGGGAATAACCGCGAATGCTCTGTGCAGCTGGACTCTGTTTCCGGAAAGTAAATGATTTGCTTTTATGCCTGTTCTGAATGG
CAGCACGAAGCAGGCCTGTTACTTGTATGTCGCTTTGGACAGAGGAAAGTGGGGTAAAATGCTACCTGTACGTCTGACATGAAAAC
TTCTCACCGCCTCAGCAGCTGAACTAAAAACCTGAATAGCCATGACAAGAGTTTGCATTTTCTTGATGATTCATCTCCATGAGTGC
ACAATCCTGAACTCACTGTCTTTTCTCCACACTTGTCCTAAGCCAAGGTAGATTTGTACGTAGACAGACTGGTGAGCAAGCATTA
TATTTTATTTTTACCCTTGCATGACATTTTCATTTTAATCAATAACATTATTTGGCCTGAGCTTGTGGGTCTGTTCAGACTGTCTC
CTCTCATGGTTTGAAACTGCATCTGAATGCCTGCCTTCAATCCTGGCCAAGTTGGAGTAGACTGGTATGAGAAAACTATGATTAGT
TCACATTTACTGGTGCATCCTTGATCCTCTCACAGATAGAGGTCTTTAAAGGTTGGACCATGTAACATTGCTTAGTAGAAGAATCTT
CTTCTAAGGATGATGGGCTTTCTACAGCCTGCTTACCACTAACAGTAAGGAATCTTTCATAAACACACCTCAGTTTGTTCCCAGTG
GGCTTAGAGGGAGGACCTGATGACTGATTCCAGGATACTTGTACTTCTAATAACATTTTTCATGAATCATGAGAAAATTTCCACAG
ATACTTCCCTTAGAAAATTTGCTATAAACTCTGTATCATTGGTAGCACAAATTTGAGCGAGGCCTTGTCAATTTTAAGGTGGAAAT
AGGAAGGACCCACAACATGACCCGTAAGTCAAGAAGGTAGACATTTCATATCCAGCTTCCTTGCTTAGTCTCCTTTCAGTATTTGGC
AATAAAAGAAAGAAGAAATAGAACAGCTGAAGTCTCAAATCATTTGCTTCTGGAATTTTCCTCACCTTGGCTAGCTCCACCTGCTCTTT
GTCTAAGGCCCTTGCCTCATCAGGGATTAGAACTGGCCCATATGCCAGAACCTGTACTAAATGCCTAATTTGTATGGAAGAGTGCA
TATTTAATCTCTTTTCTATACTGCTCCTTTCTGATGCTTATCCTTTCATCTGTGTGATTGTTTTTTCCCCTCTACTAACAAGATCC
TCCCAGCTTTCTCTCTACATGTAGAAAGGATAACATTTCTCATGAACCCACTGCCCCTCTGCATTTTCCTCACTGGTTAGAGATTA
AGTAAATAGGATAGAATATGCTGCGTCTCCCCTGACACACACTTTCTTTTTTGAATGAGCAAGTCTCCATTTTGCTCTTAGTAGAAGAAAG
ATTTTTTCTCCTTTTCTTTGTCCTCAACCATACTTAGAGGGAAAGAAGGAATGGTCTTCCATGAACTGATTATGCTTAATTAAGCAA
AGTAAGGAAATTAGTTTCATGGAAGCCTAAACAAAGCTGGAATAGAAACTACACACTAGACACAGCAGTAGTCATAGTCTTCACAG
GTTTAGGAGCTACTGGACCAACATTCTTGTTTTTGCTTTTGTTTTTTAAATAATTCTAGTCTGGAGCTAACTGTGGAGCAGCCAA
ATAGTAGCTGGCATGTTGATTCAAACCATGGGCTGAATTTGCTCATAGGCTGTGCATCACGAAAAGCTTGAATATTTGTGTTGTA
TGCTTGTTCCAACCACCGCTTGTGTGAGCATTTTTGTGGCTTGACAGAAAGTACACTTTTAAATTGTCTCTTGCATCACTAAAT
TTTTTTAAAATGAGCATAACAACGAAAGGCATCCAGCTGACTTTTTGATTCCAAGATTATTGATTGGATTGACTTTTTTGCATTAA
ATTTTTCCCAGCAAAATAAATCATATGGCGAGTCAGGGAATAAAAAGTCAAAAGAAACAAATAGAAGCTTTTTTTTTAAAAAATG
TATTGCTTCTGAACTTTTTCTGCCACTGCTCCCTAGCCCTGTTTAGTTTGTTATTGCTGCTTTTCTTTTTCTTTTCTGTATCTAT
GCCTTTTTTTCACAGTAGTCCTTGGCTCTGCACGGAATAAATGATACCCTCAAATCTAATTGGATGTGCTTTCGCCTTTGCATGTA
AGTACGGTAGTAAGAAACCTTTGAGATCTTTCTGACTTTTCAAAATTAGAGAAAGCAAATGGGATGGATAGATTTTTTTTTCTTTT
CAAGGGGGGCAGGAAGGTAATGGTTTGAGTAGCCTTTGTTTAAAAAAAAGACTAAATATATTTAAAAGGCCACATTTATATTTTT
TCACAAGAACCACATAATAAATTCCACTTCTTGACCTGAATTTGGAAATCCAGAAATTACTAATCCAGGCCAGGTGTGGTGGCTCAT
GCCTGTAATCCCAGCACTTTGAGAGGCCGAGGTGGGCAGATCACTTGAGGCCTGGAGTTCAAGACCACCTTGGCGAACAGGTGAA
ACCCCGTCTCTACAAAAAATACAAAAATTAGCCAGGCGTGGTGGCACGTGCCTGTAGTCCCAGCTACTTGGGAGGCTAAGTCAGGA
GAATTGCTTGAACTTGGGAGATGGAGGTTGCAGTGAGCCAAGATTGCACCACTGCATTCCAACCTGGGTGATGAAGTGAGACTCTC
CAAAAAAAAAAAGAATTATTAATCCCTGCCTGTGCTCTACATAGCCTCATGGGACTCATTGGATAGCTCAGAGGGCCCTTGATT
CTGGCAAGGCAAATAAAGCCAGAATGAGAAATTACCATCTTCTACTAGAGAAAACCAAGAGAAAAATTTTTATGCTAGGATGCCTT
TATGACCACTTAATTTTTTAATCTTAGTTTAATGGTCTCTCCCTGGTGCTAACTGCTGACAGTGGCCACCTCTTTTTTGGGGATTG
AGGGGCCTACATAACTAGCTGGCCTTACCCCATATCTTTTGTTCAAACATAATACCATCTTTTTGCTTCTTCTGAACTTTAGATCT
CCATAACACATGTGCTGTAGAATGTGATGAAAAAGCATTGATGAGAATTTATTGGCAGTTCAGATTGTGTTTTCCCAACTTAGGCT
CTTTATTAATTGGTTAAGGTTTCTCCAAAAAGGGCATTTCAACAATGGGAATTTAATGTAACAGTGGGCACAGATTACTTAT
CTTCCTTCTCTGCTTTGTGACTCACCAGCAGTAACACACACAATCCACATCTTGTGCACCTCAAATGAACAGACTTGGTTTCCTTG
CTTTCTTGACATTTCCATGACTGTTTCACATACAAACTATTGGGTGAGGTTTTCAGCTGTTACCGACCCACGTCCTGCTGTCTCT
GTGTGGTCCTACAAAAACTGTCCATTCCCACCCCTTTGCTTTGCCATTTGCAAGAGTCTGGAATTGTCAGGTCTCAGCTTCGAAAA
GTCCTGGTTCCACTGACAGGACACATTCTTTAGTGGGAATTAAGACCTAGTTTGTATGTAGGTATGAAGGGAATTTT
TTAAATAAATTGAAAAGCTGTGAACAGCATTAGAACTTTGTCTATTTCTTAATTTTAAAATATGCTGATATGCCTTAAACTGTAGT
TGTAGATCCTTGTCATCTTGCTGTTTGAAAATAACCAATGTGTTTTCTAAAACTGTCGTGTAATCTACTTTCATTGTTAATGCAGA
ATTGTCATATATGTAAGCTGCATGTTAGACATTTGTCTTTTTAAACTAAAGTATTGATGTGAAGCATATCATTTTTTCAAATATG
AAAGTGATCACTTAGCAACATGCTTGGTAATTTGGCATCTGTTAAGGTAGGAGAGTGGTGAACAGATAATCTATGCATATATCACT
AGTGCCAAGACATAAAGCGGGGAAAATATATTTTTACCCAAACCTTAAAAAAAAAAAAAAAAAAAAAAAAAAAAAAAAAAAAAAAA
AAAAAAAAAAAAAAAAAAAA

103 TGAGATGCTGCATTTCCTGTCAAGTATATGCTGATCCTGTCGAAGTTTTACCACCTGCAGTTACCACTTTTTCATCTTTTTTACTG
ACTCGTAGAAGATGTGTGTGAAGTTTTGACATATTTCCCCACTGTCCTATAAAGTGACTTTGTTGGTCGATATTTAACTTCCAGAA
CACTGAAGAGAATCATCTTCGGGTGACATAATTTTGAGTTAGGGTGTGTATGATAGAAATTGTTATGCTTATCAGAAGGCATTTAT
TAAATTTTGTGGCGCTGACCTTGCTCTCCAAAAAAAAAAAAAAGAATTGTTTACAGAAGTAACTATAGTGTGAGTCAGAAATATATT
AATGCCATTAGAGAAATTCAAATCAATACCATGGAAGTTTTGATGAGGGATTGCATTCAATATGAGACGATCATGGAAAACTTCAC
AAAGGAGCTGACATTTAAACTAGGTTTCTTGAAAGAGTAGGAATTTAATAAAGACAGTGAGATCAATAGTTGGGGGTTGGAGAATA

TABLE 1-continued

Sequences Table. First column: SEQ ID No. Second column: corresponding mRNA sequence. For the 3 different groups, see explanation in the text.

|     |     |
| --- | --- |
|     | TGGGATAAATGAAGGAGGGGCAATGGAAAAGCACAATACATTTTGGGAAAAGTCCAGTCTGACTGGCACATATGATACGTGTATGG<br>GAACAGCAGGAGATAATGGGAAAAACAGGATGCTGCTAGATATTGAATGGTTTTTAATACGAGGCTAAGGAGTTTGGGTCCTATTT<br>CTGTAGGCAACTGTGTGCTGTTAAATAATAATTGTGTTTTACAGAGATTAATTGTCTGAATTAGGGGAAAGTGAGTCAATACCTGT<br>TAGTGTTAGGCTATTAACAATAGTTAGGTGAAAGGTAATGAGGGCATTGAGAAGGAAGAGTGATGTGTTACTGTGGAGGAGGAATT<br>GATATGAATTGGTATGACTTAGCATATAGTTGGATATGGGAAAAGATGGGGAGGAATGAGTCAGATCATTTAGAACTTCGTATGTT<br>GGGAACACTGGAAGATTTGAGATGTTTAAATTAAAACTGAAATTGGAATGGCAGGAGATGAAGTCAATTTTGCAAGGTGGCTGGA<br>TTTAAAGAGATAATATTTCAAACTGGAAAACGTTAAGTGTTAAGTGCTAATAGGATATGCAAGTGGAAATGTTCAGCAAACATTTA<br>AATTAGTTAGGAAAGAGGTGAAACTGGTAGTAGAGATTTGGAAGTAACTTGTGCTTAGCACTCTCCCAGGCTGGAGTGTAGTGGCA<br>CCATCTCGGCTCACTGCAACCTCCGCCTCCCGGGTTCAAGTGATTCTCATGCCTTAGCCTCTCAAGTAGCTGGGATTGCGGGCGCC<br>TGCCACCACGCCCAGCTGATTTATGTGTTTTTAGTAGAGACGGGGTTTCACCTTGTTGGCCAGCCTGGTCTCGAACTCCTGACCTC<br>AGGTGATCCGCCTGCCTCATCCTCCCAACGTGCTGGGATTACAGGCGTGAGCCACCACGCCAGGCCAAAAGCACTACTATATGACA<br>TGTTACCTGTTGTAAAGTCTGGACTCCATAAACCACGGATTGCAACCATCTCATTCATCTGTTCACATATTTTTTGTGTCCATTGT<br>GTGCTCAAAGCTTTTATAGCTGAGACCATGATTGGTGCCTCTTCTCCGTAGGGATTTCCAGCACACTTGAGCAAGGAAAGGTGGAA<br>AGTGTTAAGTGTTAAGGGGAAGTGTTTAGAGAGGAAAGCAGTCTGACATGTAAGTTATATAAATATTGAGTGAATGAACTAGGTTA<br>GAATTAGGAACTACATGGATCTCAGTCTGTTAAGATAACAATAGTAATTCATACAAATAAGTAGAGAAAGTGTACCTGTGACTAAC<br>TTTTAGTAAAAAGTAATAATTAGGCCCAGGCACAGTGGTTCATGCCTGTAGTCCCAGCATTTTGGGAGGCCGAGGCGGGTGGATCA<br>CGAGGTCGGGAGTTCGAGACCAGCCTGGCCAATATGGTGAAACCCCATCTCTACTAAAGATACAGAAATTAGCTGGGCGTGGTGGC<br>ATGCGCCTGTAGTCTTAGCTGCTGGGGAGGCTGAGGCAGGATAACTGCTTGAACCCAGGAGGCGGAGGTTGCAGTGAGCTGAGATC<br>GCACCCGCCTGAGCGACAGAGCGAGACTCTGTCTCAAAAAAAAAAAAAAAAAAAAAAAAAAAAACA |
| 104 | CGCGCGGGCTACCTCAGTTCTCGGGCGTACGGCGCGGCCTGTCCTACTGCCGCCGGCGCCGCGGCCGTCATGGGGTTCCTGAAACT<br>GATTGAGATTGAGAACTTTAAGTCGTACAAGGGTCGACAGATTATCGGACCATTTCAGAGGTTCACCGCCATCATTGGACCCAATG<br>GCTCTGGTAAGTCAAATCTCATGGATGCCATCAGCTTTGTGCTAGGTGAAAAAACCAGCAACCTGCGGGTAAAGACCCTGCGGGAC<br>CTGATCCATGGAGCTCCTGTGGGCAAGCCAGCTGCCAACCGGGCCTTTGTCAGCATGGTCTACTCTGAGGAGGGTGCTGAGGACCG<br>TACCTTTGCCCGTCGTCATTGTAGGAGGTTCTTCTGAGTACAAGATCAACAACAAAGTGGTTCAACTACATGAGTACAGTGAGGAAT<br>TAGAGAAGTTGGGCATTCTCATCAAAGCTCGTAACTTCCTCGTTTTCCAGGGTGCTGTGGAATCTATTGCCATGAAGAACCCCAAA<br>GAGAGGACAGCTCTATTTGAAGAGATTAGTCGTTCTGGGGAGCTGGCGCAGGAGTATGACAAGCGAAAGAAGGAAATGGTGAAGGC<br>TGAAGAGGACACACAGTTTAATTACCATCGCAAGAAAATATTGCGGCTGAACGCAAGGAAGCAAAGCAGGAGAAAGAAGAGGCTG<br>ACCGGTACCAGCGCCTGAAGGATGAGGTAGTACGGGCTCAGGTACAGCTGCAGCTCTTTAAGCTTTACCATAATGAAGTGGAAATT<br>GAGAAGCTCAACAAGGAACTGGCCTCAAAGAACAAGGAGATCGAGAAGGACAAGAAGCTATGGACAAGGTGGAGGATGAACTGAA<br>GGAGAAGAAGAAGGAGCTGGGCAAAATGATGCGGGAGCAGCAGCAGATTGAGAAGGAGATCAAGGAGAAGGACTCAGAATTGAACC<br>AGAAGCGGCCTCAGTACATCAAAGCCAAGGAGAACACCTCCCACAAAATCAAGAAGCTGGAAGCAGCCAAGAAGTCTCTGCAGAAT<br>GCTCAGAAGCACTACAAGAAGCGTAAAGGTGACATGGATGAGCTGGAGAAGGAGATGCTGTCAGTGGAGAAGGCTCGGCAGGAGTT<br>TGAAGAACGGATGGAAGAAGAGAGTCAGAGTCAGGGCAGAGATTTGACGTTGGAGGAGAATCAGGTGAAGAAATACCACCGGTTGA<br>AAGAAGAAGCCAGCAAGGAGCAGCTACCCTGGCCCAGGAGCTGGAGAAATTCAATCGAGACCAGAAAGCTGACCAGGACCGTCTG<br>GATCTGGAAGAACGGAAGAAAGTAGAGACAGAGGCCAAGATCAAGCAAAAGCTGCGGGAAATTGAAGAGAATCAGAAGCGGATTGA<br>GAAACTGGAGGAATACATCACCACTAGCAAGCAGTCCCTAGAAGAGCAGAAGAAGCTAGAGGGGAGCTGACAGAGGAGGTGGAGA<br>TGGCCAAGCGGCGTATTGATGAAATCAATAAGGAGCTGAACCAGGTGATGGAGCAGCTAGGGGATGCCCGCATCGACCGCCAGGAG<br>AGCAGCCGCCAGCAGCGAAAGGCAGAGATAATGGAAAGCATCAAGCGCCTTTACCCTGGCTCTGTGTACGGCGCCTCATTGACCT<br>ATGCCAGCCCACACAAAAGAAGTATCAGATTGCTGTAACCAAGGTTTTGGGCAAGAACATGGATGCCATTATTGTGGACTCGGAGA<br>AGACAGGCCGGGACTGTATTCAGTATATCAAGGAGCAGCGTGGGGAGCCTGAGACCTTCTTGCCTCTTGACTACCTGGAGGTGAAG<br>CCTACAGATGAGAACTCCGGGAGCTGAAGGGGGCCAAGCTAGTGATTGATGTGATTCGCTATGAGCCACCTCATATCAAAAAGGC<br>CCTGCAGTATGCTTGTGGCAATGCCCTTGTCTGTGACAACTGGAAGATGCCCGCCGCATTGCCTTTGGAGGCCACCAGCGCCACA<br>AGACAGTGGCACTGGATGAACCCTATTCCAGAAGTCAGGAGTGATCTCTGGTGGGGCCAGTGACCTGAAGGCCAAGGCACGGCGC<br>TGGGATGAGAAAGCAGTAGACAAGTTGAAAGAGAAGAAGGAGCGCTTGACAGAGGAGCTGAAAGAGCAGATGAAGGCAAAACGGAA<br>AGAGGCAGAGCTGCGTCAGGTGCAGTCTCAGGCCCATGGACTGCAGTGCTGCTCAAGTACTCCCAGATGACCTAGAACAGACCA<br>AGACACGACATCTAGCCCTGAATCTGCAGGAAAAATCCAAGCTGGAGAGTGAGCTAGCCAACTTTGGGCCTCGCATTAATGATATC<br>AAGAGGATCATTCAGAGCCGAGAGGGAAATGAAAGACTTGAAGGAGAAGATGAACCAGGTAGAGGATGAGGTGTTTGAAGAGTT<br>TTGTCGGGAGATTGGTGTGCGCAACATCCGGGAGTTTGAGGAAGAAAAGGTGAAACGGCAGAATGAAATCGCCAAGAAGCGTTTGG<br>AGTTTTGAAAATCAGAAGACTCGCTTGGGCATTCAGTTGGATTTTGAAAGGAACCAACTGAAGGAGGACCAAGATAAAGTACACATG<br>TGGGAGCAGACAGTGAAAAAAGATGAAAATGAGATAGAAAAGCTCAAAAAGGAGGAACAAAGACACATGAAGATCATAGATGAGAC<br>CATGGCTCAGCTACAAGACCTGAAGAATCAGCATCTGGCCAAGAAGTCGGAAGTGAATGACAAGATCATGAGATGGAGGAGATTC<br>GTAAGAAACTCGGGGCGCCAACAAGGAAATGACCCATTTACAGAAGGAGGTGACAGCCATTGAGACCAAGCTTGAACAGAAGCGC<br>AGTGACCGTCACAACTTGCTACAGGCCTGTAAGATGCAGGACATTAAGTTGCCACTGCTCAAAAGGCACCATGGATGATATTAGTCA<br>GGAAGAGGGTAGCTCCCAGGGGGAGGACTCAGTGAGGTTCACAGAGAATTTCCAGTATCTATGCACGAGAGGCCCTCATTGAGA<br>TTGACTACGGTGATCTGTGTGAGGATCTGAAGGATGCCCAGGCTGAGGAAGAGATCAAGCAAGAGATGAACACACTGCAGCAGAAG<br>CTGAATGAGCAGCAGAGTGTGCTTCAGCGTATTGCCGCCCCAACATGAAGGCCATGGAAAAGCTGGAAAGTGTCCGAGACAAGTT<br>CCAGGAGACCTCAGATGAGTTTGAAGCAGCCCGAAAGCGAGCAAAGAAGGCCAAGCAGGCATTCGAACAGATCAAGAAGGAGCGCT<br>TTGACCGCTTCAATGCTTGTTTTGAATCTGTGGCTACCAACATTGATGAGATCTATAAGGCCCTGTCCCGCAATAGCAGTGCCCAG<br>GCATTCCTGGGCCCTGAGAACCCTGAAGAGCCCTACTTGGATGGCATCAACTACAACTGTGTGGCCTCCTGGGAAACGCTTCCGGCC<br>TATGGACAACTTGTCAGGCGGGAGAAGACAGTGGCAGCTCTGGCCCTGCTCTTTGCCATCCACAGCTACAAGCCAGCCCCCTTCT<br>TCGTCCTGGATGAGATTGATGCTGCCTTGGATAACACCAACATTGGCAAGGTGGCAAATTACATCAAGGAGCAGTCGACTTGCAAC<br>TTCCAGGCCATCGTCATCTCTCAAGGAGGAGTTCTACACCAAGGCCGAGACCCTCATTGTTGATGAGCAAGGGACTG<br>TGTGATCAGCAAAGTCCTGACCTTCGACCTCACCAAGTACCCAGATGCCAACCCAACCCCAATGAGCAGTAGCAGTATTTTGCC<br>CTCCCGCCCTGTCTGGATCCCTAAGCTGTCCCTCTCCCAATCTCTGGATATTTGACTCCCAACCTTCCCCCTACCTCCTGGCCCTT<br>TTTGGTGTAGTCATGGGATTTAGGCACTGCTAATCAAGCATGAAGAGGAACAGAGGTGATGTTAGGTCTGGAGCAAAAATTCCTGA<br>ACGACAGGGAGTATTCTGGCCTCTGAAAGGAGGTGCTGAGCTGACAGGGCCATCTGTTCATCACACACACCCCCTTCCTCCCCCT<br>CATCACCCATAATCGTGGGCCCCTTGGGCCTCTTGCCCACTGTGTGTGTGGGTATGTATGTGTATGTATGTATCCGCATGTGTG<br>CATGTGAGTATGTTGCAAATAATAAAGGATATTGGAACCTGTTTTAGAAGGAGCCTAGGCTGAATTTGATTCCAAGAGAGCTT<br>AGGATGACAGCACCCCTGAGCTGGGCAAAGGTACTCAGGACCTCATAGGAGTCTTAGGCAGTTACCTGAAACTGCCTTCATTCACT<br>CATTTGTGTATTCATTCATTTATGTCATTCATCAGACACATACCGAACACCCTCTATTTGTCAGGCTCTGTGCTTGGAATACAGAT<br>TGAATCAGACATGATCTCTACCCTCCTAGTAAGGAGATACAGTGGGTTCATGAATGACTATAGTTAGCTGAATGTCATATGTACTT<br>TGAATTTGAGAAGTGGGTGATCCCCTCTAGGCTTCCTGGAGGTCACATTTAAGCTAGACCTTGACAAATTGGTAGGATTTGGTCAG<br>GCACTAGGAGTGGAGCATGAGCTCTGGGGACAGACAGTTATGGGTTCTGGTCCCACTTTTTATCACTTACTAGTTGTTTGACCTTG<br>GGCAAGTCATTTGACCTTCTGTGCCTCAGTTTCCTCATCTGTAAAATGGGGCTAACAATATTACCTACCTCATAGGATTTAATGAT<br>GTCAAGCTCCTCACTGGAGGCCTTATCCCTTCGTGGAGCCCACTAGGTGCCGACCCCTCAGAATATAACCCTCATGCCTGGACCCC |

TABLE 1-continued

Sequences Table. First column: SEQ ID No. Second column: corresponding mRNA sequence. For the 3 different groups, see explanation in the text.

TGAGAGCTTCTGATCCCAGCTATTAGGGACAGAAGAAGCCTCCAAATCTGGAAGGTGCTGAATGCCCTGCTGACTGGGAAAGTTTC
AGGGCACTGATGGGGTCTACCTGGTAAGCGGAGGGCCTGAGGAAACCTGTAGCTTCAATCATGTCTGGTAACCGGGTGCCTGAGCC
CCAATCTGGGTTGTGAGGAAATAGGGGAGAGGTATCCTGGGCCACATCCCAGCCTAACACCTGTGAGGTTCATTTTAGGAACTAAC
CTCATTAGCTATAAGGATCATGCAGAGGCAGCAAAGCCGGGTGCGATGAGCTCAGCCTTTACTCATTCACATACACCATCACACTT
TAATTCCAATCTGTATATTGCTTTTTAAAAGTTAAGTCCATTCTAATTACCCAAATATGCATGAATTCATTCTCCTTTTGAGAAGT
TAGATTGTTAAAGATAGTCTCATTCAGCTACCAACCACTCCTTGATCCTTCCCTTCTTAGTGGCTGTTGTTTGTTGTACTTCCGTT
TAGACTTTGTTTTAATGCTTGTACGTACATATGTGAACTCATTGGAAATATTGTGTGTTTAATGCAAATGATATATTGAATTGTTT
AGCAATTTGTTTTCTTTGCTTAACGATGTTTTTGAGATCTGTGCATGTTACTTAATGTAGCTCAATCCATCTTCTGTAATTGCTGT
ATAGATTGTCATCATATGATTACCACATTTTACTTACGCATTTCTTTTTGTGATGGACATTAAGACTGTTTTTAGGTTTTGCTATTA
CAAAATACTACACAGGAGCATCACTATGCCTGTGTGAAAGTATATGTATGAAAGTTTACCTAGGGTTGATTCCTAGAAGTGGAATT
GCAAAGTCATAGGATATTTATATATTGGTTTTTAATAATACTTCCAAATTGCCCTCCTGTACTATTTACTCAGTATTTTTCTTGAG
GTTGATCTGAGGTCTAACATTGTTATCCTATATCATTTTCATCCCAAGTAGTGATATCTGTGAAATCACAGGTTTGATGTGTGCTA
ATTATGTATTCTTCTAATACATATTAAAAGACATAACTATCAAAACAAAATAAATTTGTCTGTTTTCAACCAAAGAAGTCACGTAC
CACTGGTGGTACTGTGTGCCATAATTTGGCAAATGCTGGCCTTTATGGACGAGCACAATTCGGGGGTCAGACCTGGTTCAAATTCT
AGCTGTAGAAACTTGTGCAAGTTACTTCACCTCTGAGCCTAAGTTTCCACATCTGTAAAAGGAGATAATAAACACCTACCTTGCAG
TAGTGAAGCAAAGAGAAAATTAAATATATATGAAGCAATTTGGCTGGCATCTAGATCATTCACAGCCCTTTAAAGGTCACCTTTGC
TGTTCTCCCCACTTTACAGATAAGGAAACTGAGGCCCAAAAAGGTTTGAACCCAGGTCTTCAAGTCATTCAAGTGCTTTCTCCAC
TGTACAGGTGGTTATCAACCTTGGCTGCGCATCAGAATCGTTTGTAAAGCTTTTTCTTTTTCCTTTTTAAAAAGTAAAGCAATATA
TACACAGGTAAAAAATAAAATAGTACAGAAGGGCTTATAATGAGAAGCAGCAGTTCCCTGCTTGCACCCCCACATCCAAAGGATG
TGGAGCTCTTTAAAAATAAATTGCTCTGGTCCCACCTCTGGAAATCTGATTCAGCCAGCATGGATAATAACCCAGATAACTAACCC
CTACCTCACAGGATAAAAAGGATTACATGAGATGCCTTAGGCTAAGGCCCTGGCACACAGGAACACATGTGCTACAAAGGAGCTTT
GGGGACTTAAGTCCTGAGGATCCAGGAGGTGAGGTGACTTGTCCAAGATTCCACTGGTTTAGTGGCAGAGCCTAGACTTCCACTCG
GATCTATTTAGTGCTTGCCCCCTGCTCTCCTGTCGTGCCCCACCACCTCCTGGCATCACAGGGCAACCGTTGTCAAGGCTATGC
TCACGGGAGGCTGGGCACCACAGTGTTTCCAAGAGCAAGCTGGATCCGAGTAGATTCCCTAGGGCTTGTTGGAGGAACTAGTTTGA
CTCCCTTATACTGTGGACGCAGTAGCCTTGCTGTAGGGAGTTGAAGAGTACTCCACAACAGTATCTTAAGTTTAACTGGGCACTTC
CCTCTGGAAATCACAGTGTTGTGCACCAGGAACACAAAGATGAGTCAAATCTTTATCCTGCCTTTGAGGAGCTCACTGTTTAGTTG
GGGAAACCATTTGTAAAACAGCCATTAACCATACAGTGTGATCAACACTGACAGGAGCACAGGAAAAACATCTAGCTTATGTGAAG
ATTCAGAGAAGGCATCCTGTAGTCTAGGTGGTGATACCTGAACTGAGTCTTGAGGGACGGGTAGGAATTAGCCAGTTGAGGAAGTA
GAAGGAATTTCCAGATATTGGAAACAGTATGCATGAAGACATGAAGGCAAGAAACACAAAACAAATACTGAAGCATGAAGATTCC
TGGGGTGGGGGAAAGCAGCAAGAAAAGGTAGAGAGGAACCAGATTGGAGAGGGTCGTAAATGCATGGCTACAGAATTCAGATTT
GTTTTGTAGGACAGTGTGGTTCCCAAACTGGCTGTATACCACAAACAGGTACGGCATTCTGGGCCCCGGCCCCTAAAACATTCATT
AAGTCTGGGGTGAAGATTTGGAATCTTGAATGCTTATAAAGGTTACCACATGACTAGGGTACAGCCAGATTTGGAAACCATAGCTT
GAAGGCAGTGAGGGAGCCATGAAATGGTTTTTAATAGGGGGACTCCAGATCAGATGTGAACTTAACCTGTTTCTGGCTGGCTAGCC
AACCAGCATGGAAAACAGATTAGGTTAGATGTTCATGCTGTATGTGCCCGTGCCTGTAGCTTCCCTGTTAATCAGCTTCTTACACT
ACTATATTTGCTTATTTTGTCTCTGAATAAGCTTTAGGCACCACAAGGGTGGGCCTGGGGATATTTTGCTTACCAGTATAGCCCCT
GCAAAAAAGCACAGTGCCTGACACAAACAGGCACCCAGTAAAGTTTTTGAATGAATGAATGCATGAGTGAATCCATTTGTGAGAG
AGCGAATGGAGATGACAAGATTAGCTAGGAGACTGGAAAAAGACCAGGAGGCCTGCACTAGGGCAAAGGCCAGTAGGAATAGATTG
GAGGTGTTAAGGTGTGAACTGTTAAGGTAAGATGATAACTTAATGACTGATTATTGGACTGTGGAGGGTGACTGAGAGGATAGAATG
AGTACCCATGAATAGCCATGATTCCTACCCTGTCCCAGTCATCTCTTTCCTTATCCATCTCTGAAACAATCTGCTTACATCCTCCT
CAGCAACTGGAATTCCTCAAGTTAGTTAGACATTCTGTGTGCTGTGTGGTCTCTCACTGCCCCCCACTCCCCACCCCTCCACAAG
CCATTGATTCATTCATCCAGTTCAATAAATCTTGGCTAAGCACCTCCAGTGTGCAGTAAGGCTCTTCCAAGCCAGGACTCTGACTC
CCTCTTTCCTACCTCAAGAGATGTTTTTGAGGGCTTTCCCAGGTAAGAGTCACATCTCTTATACAATAACTTATAGTGAGATACCC
AGAATGTCAGACTTGTAAGGGAAGACTGCCCAAACCCCTTCTGAGGTCCTCAGAGGGGAATTAACTTCCTAAGGTCCGACTGCTAG
GAAGTGTTGGAGCCAGAAATGGAACCTAGGTTTCCTTTCTATGTCATCTCTGGAGTCTTGATCTTGATCTATCCCATTGTAGATCA
GGACAGGCAGAGGTGGTCAGGGAGAAGGTGGGACTTAGGTTGAACCTTGAAGGTCAATGTATTGGACAGGTCAAACAAGATGGTTG
CCAATTACACTGCCCCCTTCTGGAAACCCTTAGCAAACCTGCCATGCTTGCAGTCCCTTCTAAGGGGTTTCCTTAGCATAAGTTGC
CATGCTCTGTACCATGTGACCTCACAATCCTGGCCACAGATAGCTAGATGTGGATAGTGTCTGGTTCAAGGGCAACCAATCTCTAG
GCTGGCCAGTGGCCTGTTAGCTGGACTGGCATAAGGACTTCACCTTACAGGGGTGGCATGTATCAAATGGCAAATGTATGAAACAA
CCAGATCTTTCAGGGAGGCAGAATGTGAGCTATTCAGAAGAAGTGAACGTTAATTAGAATTTAATGAGGCATTAGTGGTGGTGGAT
GAGGGGTGGCCAGAAACTAAACAGCAAAAGCAAAGAGAAAGCTGCAGAAACCATAAGTAAGCAGAGGTCATGAGACATTTGTATAA
TGAGATCACGGAGCCACAGGGTGGCAGAAGCCATGAAGCAGCAAGGCAACAATGGGCTAGAAGCCATGAAGCAATAGGAGCCACGA
GGAACAGAAACCGTGAGACAAAACTGACTATGAGATCCACAAAGCAGCAGAAGGCTTGAATAGATAAGATCATGAGACAGTAGAAG
CGATGAGACTGCAAGAACCACAAGGTAGCCAGAACCATGTGGCAACATGGCAACAGGAATGGAAGAGGCAGCAGGAGCTACAATGC
AGAAAAGCCATGGATTAATAGGAACTGAAGCGCCGGGAGCCATGAAGCTGCAGGACCCATGAGGCAGAAAAAGCCATGGGCTAGCA
TCGAGGGGGGCAGAAAGAAGTTAGTCAGTAGCAGTAGGAGGAGTATAAATACAGCCAGAAAGGAGTTGAGTCACCAATTTGGGAAG
CACTAGAGAAGGGAGCAACAGATGCCTGCAGCTGAGGGGGTGACAAGATAAGCAGGCTCTAGAGCTGCTTTGGATCATGAACCAT
TTTCAAGTTTCTGTTCTTCCATGAGGCTGCCTGTGTAGCTGTTCTTGTCTTCCTTATTTCCCTGTGAATGCTTTAATAAATCCCCA
TCACTAA

105 CAAACTCCTGAGCTCTGGCGATCCACCCTCTTCGGCCTCCCAAAGTGCTGGGATTACAGGCGTGAGCCCCCGCGCCCGGCCCAATT
TATTGTTTAATTGGGATGATGAAAAGGTTCTGGAGATGGATAGTGGTGATGGTTGTACAACATAGTGAATGCTTAATGCCACTGAG
TTGTACACTTAAAATGATTAAAATGTAAGCTTTGTTACATGTATTTTACCATAATAAAACAGTGCTTGAAAAAAGATGAAAAATTT
TCTAAATTTGGTAAATGTCAACCCACATTCCAAAAAAGTTCAGTAGCATCCCAAGCAAGATACATACAAAGCAAAGACACACCTAG
GCATATAACAGTCAAACTGCTTAAGACCAAAGCAATACTAGCACAATTAGAAAATGAAAAAATATTTTAATGACATTTACAATA
CTTTGAAAAGATATGAGTATCTAGGAATAAATTTAATGAAAGATGGGTTAAGTCTACACTGAAAACTATCAAATAGTGCTTAGAGG
AGTTAAGACACAAATAGATGAAGATATTATTTCCCATTAATTTATTTATTTCCCAGGGACTACAGGCCTTTCTTCCTTTAGGCAGC
TAGGGTGAAGGTAATTTCTAAGCATCATCTTACATATAGCTAATTCTTTTACTAAAACCATTCTATTATTCAAGGACTTTTCACTAATTCA
TGCTACTGTCAAAAAAATTAGTGAAGGTTTATTTTATATCTGTTCTATCAATGAGCATGCATGCTTTCATGGCCTCAGAAGTTTT
CAACCACTTAAAGTAAGAAAAGAAATTATACATCAGAATAGTCATCCAAAATATATACAGGTATACCTTGTGACTGGATTGTCCC
TGAGACTTCAAGAGATTCCAGGGAAGGCAGGGTGAGAAGCAGTTCCTGTTCGGCTGCGCTGAGTTCCAACTTGCTTATGGAGCAT
TGGTGACAGAGGCCTTAGACAGCTCAAGAGCTGGGCGGATGCTTTCTATAAAGCCTTCTGCTGTGTTTTAAATGGAGTTCGATGCGC
TGTGAAGCTGAGAAACTGTCATTAGAATCTCAAGCATATCCTGGCCTACAACATCAATATCATTCACATCGACTTCTAGACAGGG
AATCTTGTACTGCTTTGGAGAAAGTTTCCAATAGCCAGTACTAAGGTCTGGTGATGCCCTGCGCTGCATATCCATATAGCTCTTTA
CATTATCCTCTTTTTCAGCTAAATTTCGCTCCCATTCATTCATAGGTTCAAAGGCAGAAGCATAGTCCTGATCTATAGTTGGCACC
TGTGATTTGTCAAAACATGTTTCCAGAACTGAAAAATGTGCTCTGGGTGATGTCTTATTTCCTCGTATTGGGAAGTGGATGCTCCT

TABLE 1-continued

Sequences Table. First column: SEQ ID No. Second column: corresponding mRNA sequence. For the 3 different groups, see explanation in the text.

```
   CAACAATGACAAGCTTTCTGGGTGGTCGAAAAAGTATTGTAAGTTAAGCGCACCCAAAGTCAGTGTTCTCCCTTGAAGGAATTGCA
   AAACAAATGGAGAACACGCAGCAACAGTGTTGCTTTGATAAGCAGTTTTCAGGGCAAGAACCAGTAAATGTTCTGAAACCATTGAA
   AAGTAAGCTTGTGGACAAATTTGCCACAATCCCCTAAGTAACTGCATCTGCAGTGAAATTTCTGGCTGGTGCTTTAAGTAGTCATC
   ATTTTCAGATATATTCTCCAATGACTCTTTGTTATCCACTAAATGGAGCAAATGAGACACAATTTTGGGCCTGCTTTTGTTGAAG
   GGAGGCTGGAGACATAGTTCAAAAAATTGTTGTAGGCGCTTACAGTCATCATGGGTGAGTTGATTTGTTTCAAATGATACAGTCCC
   AAATCTTGATGTTCCTGCCTATCTGAATCCAGGAGTTCAATCAGCCTCATCCCCGCAAGAAATTCTTGGAAGGCAGGACTTAAAAA
   CCGGTAGAATGGTCTTAGTCTCTGGGCTGTAAATTTGCTCATCAAGCACATGGTTAGATCTTCATCTTCATCAACCCCTGCTTCTG
   CGAGATCATCATCATTAAACTCAAAGCAACATGAAAAAAAACCCTTTCAAGGCCAGCTCACCACAGGAGGACACAGTTGCTTTGAGA
   ATTTCAGCTGTCGCTTTGTTCCTTAAGGAAAGGCGTTCCATATAGGACTTGAAAACAGCCACATCATCAAAGGATGGGTCAAAAGG
   ATACTGAAACCAATGAGCACAGATCGCCGCCACAAAGAGAGGAGTTTTCTGTATCTTCTGCAAACTTTGGTTCTTTCCAAAGTAAA
   CCATAAACTTTCGCAGACGAGTCATATTATGTGAAAAGAGCTTCCGTAATATACAGACAGTATTATAAAAGGGAAATGCTTTGATC
   TCTAGAATGGTCTCTAGGTATCGGCGGATGTCCCTGGCCCTGTTTGTACGGACAGCAATCAATAGGCAGGTCCGGGATAAGTGGTT
   TTTTTGAATCAGTTTTCCTATGACTTGAGGGATTGAACATATTTCTTTGTAGTCATCTAAAAGGAATAAGACCTGATTCTTTAACT
   GCTGGATAATGTTCCTCATGCACATTTCAGTAACAGATCCTTCTTTCTCTAGGAGCTGGTCACAGATGATACTGGCCAGCCCCTCG
   TCTGGTCTGGTGGAACTAAGGGAGAGGTAGAAAACCAGCTGGAACCTGTTTAACAGGGGACAGCATCCAGATGCCCACAGAAAAGC
   TATTTTCTTCAGGAGGACCGTCTTTCCACTTCCAGCTTCACCCTCCACACACATGACAGAGTTCAAGTTGCCAAAGACCTCAGGCA
   GCACCAGAGGTTCTTGCACAGGTTTGCTGATGTGTTTTGAAGCAATAGACAGATCACAGCCCAGCAAGTGGTCCGTGGCCAGATCG
   GAAGAGATATCAAGCAAAGACATGTGGCGGAAACTGGCGCTGGTATAAGCTGCTCTCAGCTGCTCATTCAGATTCTTTGCCTCTTG
   AAACCACTGGGCTTCACCCTGTGCCATTTCTGTGGAGAGAAAGAAAGGGGGGCACAACAGGGATTCATAGTCACATCTCCCTCAGT
   CTGAACGCCATGCCTTTTCATTTCATGATTCTGCCTGTCTACTACGAATGTGTTAGGATTTTCCACAGCCATCCATGATTCCCACA
   TTGCGATCATCTCATAGGTTTTGGCACAAATCGGAATGTGGAAAGCATGTGTCCAAAGTGCCACACTTGAAGCAGGGACCTAGAC
   ATAATGTGTGCTTATCATAAGCACCATGCATCTCAGGAAAGAGGCCAGGCAAAGTGACTCATGCCTGTAATCCCAGCACTGTGGGA
   GACCGAGGCAGGCGAATTGCTTGAGCCTAGGAGTTCAAGACCAGCCTGGCCAACATGGCAAAACCCTGTCTCTACAAAAAATACAA
   AAATTAGCCAGGTGTGGTGGCACATGCTTGTGGTCCCAGCTACTGGGGAGGCTGAGATGGGAGGATCACTTGAGCCTGGGAGGTCG
   ACGCTGCAGTGAGCCATGATCTTGCCATTGCATTCCAGCCTGGGTGACAAAGTAAGACCCTGTCTCAAATAAAATAAAATAAAATA
   AAATGAAT
106GTCTCTTAAAACCCACTGGACGTTGGCACAGTGCTGGGATGACTATGGAGACCCAAATGTCTCAGAATGTATGTCCCAGAAACCTG
   TGGCTGCTTCAACCATTGACAGTTTTGCTGCTGCTGGCTTCTGCAGACAGTCAAGCTGCTCCCCCAAAGGCTGTGCTGAAACTTGA
   GCCCCCGTGGATCAACGTGCTCCAGGAGGACTCTGTGACTCTGACATGCCAGGGGGCTCGCAGCCCTGAGAGCGACTCCATTCAGT
   GGTTCCACAATGGGAATCTCATTCCCACCCACACGCAGCCCAGCTACAGGTTCAAGGCCAACAACAATGACAGCGGGGAGTACACG
   TGCCAGACTGGCCAGACCAGCCTCAGCGACCCTGTGCATCTGACTGTGCTTTCCGAATGGCTGGTGCTCCAGACCCCTCACCTGGA
   GTTCCAGGAGGGAGAAACCATCATGCTGAGGTGCCACAGCTGGAAGGACAAGCCTCTGGTCAAGGTCACATTCTTCCAGAATGGAA
   AATCCCAGAAATTCTCCCATTTGGATCCCACCTTCTCCATCCCACCAAGCAAACCACAGTCACAGTGGTGATTACCACTGCACAGGA
   AACATAGGCTACACGCTGTTCTCATCCAAGCCTGTGACCATCACTGTCCAAGTGCCCAGCATGGGCAGCTCTTCACCAATGGGGAT
   CATTGTGGCTGTGGTCATTGCGACTGCTGTAGCAGCCATTGTTGCTGCTGTAGTGGCCTTGATCTACTGCAGGAAAAAGCGGATTT
   CAGCCAATTCCACTGATCCTGTGAAGGCTGCCCAATTTGAGCCACCTGGACGTCAAATGATTGCCATCAGAAAGAGACAACTTGAA
   GAAACCAACAATGACTATGAAACAGCTGACGGCGGCTACATGACTCTGAACCCCCAGGGCACCTACTGACGATGATAAAAACATCTA
   CCTGACTCTTCCTCCCAACGACCATGTCAACAGTAATAACTAAAGAGTAACGTTATGCCATGTGGTCATACTCTCAGCTTGCTGAG
   TGGATGACAAAAGAGGGGAATTGTTAAAGGAAAATTTAAATGGAGACTGGAAAAATCCTGAGCAAACAAAACCACCTGGCCCTTA
   GAAATAGCTTTAACTTTGCTTAAACTACAAACACAAGCAAAACTTCACGGGGTCATACTACATACAAGCATAAGCAAAACTTAACT
   TGGATCATTTCTGGTAAATGCTTATGTTAGAAATAAGACAACCCCAGCAATCACAAGCAGCCTACTAACATATAATTAGGTGACT
   AGGGACTTTCTAAGAAGATACCTACCCCCAAAAAACAATTATGTAATTGAAAACCAACCGATTGCCTTTATTTTGCTTCCACATTT
   TCCCAATAAATACTTGCCTGTGACATTTTGCCACTGGAACACTAAACTTCATGAATTGCGCCTCAGATTTTTCCTTTAACATCTTT
   TTTTTTTTTGACAGAGTCTCAATCTGTTACCCAGGCTGGAGTGCAGTGGTGCTATCTTGGCTCACTGCAAACCCGCCTCCCAGGTT
   TAAGCGATTCTCATGCCTCAGCCTCCCAGTAGCTGGGATTAGAGGCATGTGCCATCATACCCAGCTAATTTTTGTATTTTTTATTT
   TTTTTTTTTAGTAGAGACAGGGTTTCGCAATGTTGGCCAGGCGATCTCGAACTTCTGGCCTCTAGCGATCTGCCCGCCTCGGCCT
   CCCAAAGTGCTGGGATGACCAGCATCAGCCCCAATGTCCAGCCTCTTTAACATCTTCTTTCCTATGCCCTCTCTGTGGATCCCTAC
   TGCTGGTTTCTGCCTTCTCCATGCTGAGAACAAAATCACCTATTCACTGCTTATGCAGTCGGAAGCTCCAGAAGAACAAAGAGCCC
   AATTACCAGAACCACATTAAGTCTCCATTGTTTTGCCTTGGGATTTGGAAGAACAGATTAGAGAGGTGAGGATCTGGTATTTCCTGG
   ACTAAATTCCCCTTGGGGAAGACGAAGGGATGCTGCAGTTCCAAAAGAGAAGGACTCTTCCAGAGTCATCTACCTGAGTCCCAAAG
   CTCCCTGTCCTGAAAGCCACAGACAATATGGTCCCAAATGACTGACTGCACCTTCTGTGCCTCAGCCGTTCTTGACATCAAGAATC
   TTCTGTTCCACATCCACACAGCCAATACAATTAGTCAAACCACTGTTATTAACAGATGTAGCAACATGAGAAACGCTTATGTTACA
   GGTTACATGAGAGCAATCATGTAAGTCTATATGACTTCAGAAATGTTAAAATAGACTAACCTCTAACAACAAATTAAAAGTGATTG
   TTTCAAGGTGATGCAATTATTGATGACCTATTTTATTTTTCTATAATGATCATATATTACCTTTGTAATAAAACATTATAACCAAA
   ACA
107TTTTTAGAAAAAAAAAAATATATTTCCCTCCTGCTCCTTCTGCGTTCACAAGCTAAGTTGTTTATCTCGGCTGCGGCGGGAACTGCG
   GACGGTGGCGGGCGAGCGGCTCCTCTGCCAGAGTTGATATTCACTGATGGACTCCAAAGAATCATTAACTCCTGGTAGAGAAGAAA
   ACCCCAGCAGTGTGCTTGCTCAGGAGAGGGGAGATGTGATGGACTTCTATAAAACCCTAAGAGGAGGAGCTACTGTGAAGGTTTCT
   GCGTCTTCACCCTCACTGGCTGTCGCTTCTCAATCAGACTCCAAGCAGCGAAGACTTTTGGTTGATTTTCCAAAAGGCTCAGTAAG
   CAATGCGCAGCAGCCAGATCTGTCCAAAGCAGTTTCACTCTCAATGGGACTGTATATGGGAGAGACAGAAACAAAAGTGATGGGAA
   ATGACCTGGGATTCCCACACAGCAGGGCCAAATCAGCCTTTCCTCGGGGAACAGACTTAAAGCTTTTGGAAGAACATTGCAAAC
   CTCAATAGGTCGACCAGTGTTCCAGAGAACCCCAAGAGTTCAGCATCCACTGCTGTGTCTGCTGCCCCCACAGAGAAGGAGTTTCC
   AAAAACTCACTCTGATGTATCTTCAGAACAGCAACATTTGAAGGGCCAGACTGGCACCAACGGTGGCAATGTGAAATTGTATACCA
   CAGACCAAAGCACCTTTGACATTTTGCAGGATTTGGAGTTTTCTTCTGGGTCCCCAGGTAAAGAGACGAATGAGAGTCCTTGGAGA
   TCAGACCTGTTGATAGATGAAAACTGTTTGCTTTCTCCTGGCGGGAGAAGACGATTCATTCCTTTTGGAAGGAAACTCGAATGA
   GGACTGCAAGCCTCTCATTTTACCGGACACTAAACCCAAAATTAAGGATAATGGAGATCTGGTTTTGTCAAGCCCCAGTAATGTAA
   CACTGCCCCAAGTGAAAACAGAAAAAGAAGATTTCATCGAACTCTGCACCCCTGGGGTAATTAAGCAAGAGAAACTGGGCACAGTT
   TACTGTCAGGCAAGCTTTCCTGGAGCAAATATAATTGGTAATAAAATGTCTGCCATTTCTGTTCATGGTGTGAGTACCTCTGGAGG
   ACAGATGTACCACTATGACATGAATACAGCATCCCTTCTCAACAGCAGGATCAGAAGCCCTATTTTTAATGTCATTCACCAATTC
   CCGTTGGTTCCGAAAATTGGAATAGGTGCCAAGGATCTGGAGATGACAACTTGACTTCTCTGGGGACTCTGAACTTCCCTGGTCGA
   ACAGTTTTTTCTAATGCTATTCAAGCCCCAGCATGAGACCAGATGTAAGCTCTCCTCCATCCAGCTCCTCAACAGCCAACAACAGG
   ACCACCTCCCAAACTCTGCCTGGTGTGCTCTGATGAAGCTTCAGGATGTCATTATGGAGTCTTAACTTGTGGAAGCTGTAAAGTTT
   TCTTCAAAAGAGCAGTGGAAGGACAGCACAATTACCTATGTGCTGGAAGGAATGATTGCATCATCGATAAAATTCGAAGAAAAAC
   TGCCCAGCATGCCGCTATCGAAATGTCTTCAGGCTGGAATGAACCTGGAAGCTCGAAAACAAAGAAAAAAATAAAGGAATTCA
```

TABLE 1-continued

Sequences Table. First column: SEQ ID No. Second column: corresponding mRNA sequence. For the 3 different groups, see explanation in the text.

GCAGGCCACTACAGGAGTCTCACAAGAAACCTCTGAAAATCCTGGTAACAAAACAATAGTTCCTGCAACGTTACCACAACTCACCC
CTACCCTGGTGTCACTGTTGGAGGTTATTGAACCTGAAGTGTTATATGCAGGATATGATAGCTCTGTTCCAGACTCAACTTGGAGG
ATCATGACTACGCTCAACATGTTAGGAGGGCGGCAAGTGATTGCAGCAGTGAAATGGGCAAAGGCAATACCAGGTTTCAGGAACTT
ACACCTGGATGACCAAATGACCCTACTGCAGTACTCCTGGATATTTCTTATGGCATTTGCTCTGGGGTGGAGATCATATAGACAAT
CAAGTGCAAACCTGCTGTGTTTTGCTCCTGATCTGATTATTAATGAGCAGAGAATGACTCTACCCTGCATGTACGACCAATGTAAA
CACATGCTGTATGTTTCCTCTGAGTTACACAGGCTTCAGGTATCTTATGAAGAGTATCTCTGTATGAAAACCTTACTGCTTCTCTC
TTCAGTTCCTAAGGACGGTCTGAAGAGCCAAGAGCTATTTGATGAAATTAGAATGACCTACATCAAAGAGCTAGGAAAAGCCATTG
TCAAGAGGGAAGGAAACTCCAGCCAGAACTGGCAGCGGTTTTATCAACTGACAAAACTCTTGGATTCTATGCATGAAGTGGTTGAA
AATCTCCTTAACTATTGCTTCCAAACATTTTTGGATAAGACCATGAGTATTGAATTCCCCGAGATGTTAGCTGAAATCATCACCAA
TCAGATACCAAAATATTCAAATGGAAATATCAAAAAACTTCTGTTTCATCAAAAGTGACTGCCTTAATAAGAATGGTTGCCTTAAA
GAAAGTCGAATTAATAGCTTTTATTGTATAAACTATCAGTTTGTCCTGTAGAGGTTTTGTTGTTTTATTTTTTATTGTTTTCATCT
GTTGTTTTGTTTAAATACGCACTACATGTGGTTTATAGAGGGCAAGACTTGGCAACAGAAGCAGTTGAGTCGTCATCACTTTTC
AGTGATGGGAGAGTAGATGGTGAAATTTATTAGTTAATATATCCAGAAATTAGAAACCTTAATATGTGGACGTAATCTCCACAGT
CAAAGAAGGATGGCACCTAAACCACCAGTGCCCAAAGTCTGTGTGATGAACTTTCTCTTCATACTTTTTTTCACAGTTGGCTGGAT
GAAATTTTCTAGACTTTCTGTTGGTGTATCCCCCCCCTGTATAGTTAGGATAGCATTTTTGATTTATGCATGGAAACCTGAAAAAA
AGTTTACAAGTGTATATCAGAAAAGGGAAGTTGTGCCTTTTATAGCTATTACTGTCTGGTTTTAACAATTTCCTTTATATTTAGTG
AACTACGCTTGCTCATTTTTTCTTACATAATTTTTTATTCAAGTTATTGTACAGCTGTTTTAAGATGGGCAGCTAGTTCGTAGCTTT
CCCAAATAAACTCTAAACATTAATCAATCATCTGTGTGAAAATGGGTTGGTGCTTCAACCTGATGGCACTTAGCTATCAGAAGAC
CACAAAAATTGACTCAAATCTCCAGTATTCTTGTCAAAAAAAAAAAAAAAAAAGCTCATATTTTGTATATATCTGCTTCAGTGGAG
AATTATATAGGTTGTGCAAATTAACAGTCCTAACTGGTATAGAGCACCTAGTCCAGTGACCTGCTGGGTAAACTGTGGATGATGGT
TGCAAAAGACTAATTTAAAAAATAACTACCAAGAGGCCCTGTCTGACCTAACGCCCTATTTTTGCAATGGCTATATGGCAAGAAA
GCTGGTAAACTATTTGTCTTTCAGGACCTTTTGAAGTAGTTTGTATAACTTCTTAAAAGTTGTGATTCCAGATAACCAGCTGTAAC
ACAGCTGAGAGACTTTTAATCAGACAAAGTAATTCCTCTCACTAAACTTTACCCAAAAACTAAATCTCTAATATGGCAAAATGGC
TAGACACCCATTTTCACATTCCCATCTGTCACCAATTGGTTAATCTTTCCTGATGGTACAGGAAAGCTCAGCTACTGATTTTGTG
ATTTAGAACTGTATGTCAGACATCCATGTTTGTAAAACTACACATCCCTAATGTGTGCCATAGAGTTTAACACAAGTCCTGTGAAT
TTCTTCACTGTTGAAAATTATTTTAAACAAAATAGAAGCTGTAGTAGCCCTTTCTGTGTGCACCTTACCAACTTTCTGTAAACTCA
AAACTTAACATATTTACTAAGCCACAAGAAATTTGATTTCTATTCAAGGTGGCCAAATTATTTGTGTAATAGAAAACTGAAAATCT
AATATTAAAAATATGGAACTTCTAATATATTTTTATATTTAGTTATAGTTTCAGATATATATCATATTGGTATTCACTAATCTGGG
AAGGGAAGGGCTACTGCAGCTTTACATGCAATTTATTAAAATGATTTGTAAAATAGCTTGTAGATGCTTAAAATAAGAATGATTTTTA
GATGAGATTGTTTTATCATGACATGTTATATATTTTTTGTAGGGGTCAAAGAAATGCTGATGGATAACCTATATGATTTATAGTTT
GTACATGCATTCATACAGGCAGCGATGGTCTCAGAAACCAAACAGTTTGCTCTAGGGGAAGAGGGAGATGGAGACTGGTCCTGTGT
GCAGTGAAGGTTGCTGAGGCTCTGACCCAGTGAGATTACAGAGGAAGTTATCCTCTGCCTCCCATTCTGACCACCCTTCTCATTCC
AACAGTGAGTCTGTCAGCGCAGGTTTAGTTTACTCAATCTCCCCTTGCACTAAAGTATGTAAAGTATGTAAACAGGAGACAGGAAG
GTGGTGCTTACATCCTTAAAGGCACCATCTAATAGCGGGTTACTTTCACATACAGCCCTCCCCCAGCAGTTGAATGACAACAGAAG
CTTCAGAAGTTTGGCAATAGTTTGCATAGAGGTACCAGCAATATGTAAATAGTGCAGAATCTCATAGGTTGCCAATAATACACTAA
TTCCTTTCTATCCTACAACAAGAGTTTATTTCCAAATAAAATGAGGACATGTTTTGTTTTCTTTGAATGCTTTTTGAATGTTATT
TGTTATTTTCAGTATTTTGGAGAAATTATTTAATAAAAAAACAATCATTTGCTTTTG

108 CTTCTCACACTTTCAGGCTCTGATCGCGGCCGCAGTTTTTCCTTTTTTCTTCTGCCGTCGCCTTCTCTGCCTCTTCTCATCCTTTC
TCGCTCTGCTGCTCTGCAGTGTGACGAGTCCGAATCCTCTTCCCACCCAGCCCGCGCCTTTCTTCTTTTGCCTGCGCTGTTCTATT
TCTCCTTCGGCCGCCGCCGCCACTGCTGCACACAGCTGGTGTCGGTGCCGCGCTTTTACCCCCAAGTCGTTCCCGCAGCCTATGGC
CCAGGCCGCCTTGGGTATTTCTGCTCAAGGTAACCACATCCCTCTTTAAAAATTCCGCCGAAAAAGAGAAGACGCTTTACCCGACT
CTTTGGGCCGTTATCTCACGGCGAACTTTCTGACCAAGTATACAACTACCCAGAGGGCCTAGGAGAAGTGCTGTATAGAGAGCAGT
TCGACTTCAACGCTGAGCCACCTTGGGAACCTAGCTGATGATAGGGGGGGTTCCATCTCCCAACTTGTCCATGGAGGTCTTCACTTC
AGAAATCCAAGACTCATATTCATCCAGCTTGGTGTCAAGTGGGCTGTTGCTGCCAGAATTATCTTGTGATTATTTGAGAGATGTAT
CAGTTTCTTCTGAAGTACAATCAACTGTAGAAGCCTTTGTAGCAGTTTGTTGCATATTCTAAGGACCCAGACATAGGCTTGGTGGC
CCGTCTCTTGTCTTTCCTGGTTTATGACTTTCGGCTTTGTGGAATACGGCTGAGATGAAAGGATTTATTGATGATGCAAACTACTC
CGTTGGCCTGTTGGATGAAGGAACAAACCTTGGAAATGTTATTGATAACTATGTTTATGAACATACCCTGACAGGGAAAATGCAT
TTTTTGTGGGAGATCTTGGAAAGATTGTGAAGAAACACAGTCAATGGCAGAATGTAGTGGCTCAGATAAAGCCATTCTACACAGTG
AAGTGCAACTCTGCTCCAGCTGTACTTGAGATTTTGGCAGCTCTTGGAACCGGATTTTGCTTGTTCCAGTAAAAATGAAATGGCTTT
AGTGCAAGAGTTGGGTGTACCTCCAGAAAACATTATTTACATAAGTCCTTGCAAGCAAGTGTCTCAGATAAAGTATGCAGCAAAAG
TTGGAGTGAATATCCTGACATGTGACAATGAAATTGAATTGAAGAAATTGCACGTAATCACCCAAATGCCAAGGTCTTACTACAT
ATTGCAACAGAAGATAATATTGGAGGTGAAGAGGGTAACATGAAGTTTGGCACTACCCTGAAGAACTGTAGGCATCTCTTGGAATG
TGCTAAGGAACTTGATGTCCAAATAATTGGGGTTAAATTTCATGTTTCGAGTGCTTGCAAAGAATCTCAAGTATATGTACATGCTC
TATCTGATGCTCGATGTGTGTTTGACATGGCTGGAGAAATTGGCTTTACGATGAACATGTTAGACATTGGTGGAGGATTCACGGGA
ACTGAATTTCAATTGGAAGAGGTTAATCATGTTATCAGCCCTCTGTTGGATATCTACTTTCCTGAAGGATCTGGTGTTAAGATAAT
TTCAGAACCCGGAAGCTACTATGTGTCTTCTGCATTTACACTCGCAGTTAATATCATAGCAAAGAAAGTTGTTGAAAATGATAAAT
TTCCCTCTGGAGTAGAAAAAAACCGGAAGTGATGAACCAGCCTTCACAGTCATATTATATGAATGATGGTGTTTATGGTTCTTTTGCAAGT
AAACTGCTCTGAGGACTTAAATACCATTCCAGAGGTTCACAAGAAGATAGAAGATGAGCCTCTGTTTTACAAGCAGCCTTTGGGG
TCCATCCTGTGATGAGCTTGATCAAATTGTGGAAAGCTGTCTTCTTCCTGAGCTGAATGTGGGAATTGGCTTATCTTTGATAACA
TGGGAGCAGATTCTTTCCATGAACCATCTGCTTTTAATGATTTTCAGAGGCCAGCCATTTATTACATGATGTCATTCAGTGATTGG
TATGAGATGCAAGATGCTGGAATTACTTCAGACTCAATGATGAAGAACTTCTTCTTTGTGCCTTCTTGCATTCAGCTGAGCCAAGA
AGACAGCTTTTCCGCTGAAGCTTAAACAGGCATTAACGCTTCTTTAGATCTGAAGTTGCAGGTTAAGCTTGTCTGGTCAACATTCC
AGTGTGGAAAATAATTTAAACAATCTTATTCTCTTAATTCTTTTGGCAACAAAAACTATTAGTAATAGCTATTTGGGACCAGACA
AAATCAGCTTTCATCTATAATTCATTGGGGATAATGGGAGATTTAGATAATGTATCCAGATTTAAACCTACCAGTTTGTCCTACCC
CTTAAGCGTTTAAAATAAAATATGCAACAAAATGGATGACTTAGTGGAGATGGAAGCCCATTAATTGGGTTCCCCATTAAATCGTT
TACATACAAGAACACAGTTTTTATCTAAGGATTTGTGTTTAAAGTCTTGTAAAGTTCATGTCTTTCACCCAGATATATCAAATGT
TAGAAGACCAGTGTGACTTCATTAGATAACGTTTAGTGTATTTAGAATGTGTAAATTTGTGCTTTGAACTGTAGTTTAATAAATGT
AAAATTGCATCATAGTATTTGTTGACCTAATGTAACCCTTGTATGATTGCAATAAAATTTTGTAGATTTTACTGTTTTTTCAGG
CTAAAACTTTGGGAAAGGGGCTAGCTAGCAAAGGTAGTTTTGAAATAGATGTGTATATGGACTGTTTTGAAGGGTTTTTTTCTTTA
TAGCCCAGTTAAGTTTTGTTGGCTCGGTGCATTTTTCATTTATTTAATTTAATTGAATAATTTAAGTAAAGGTTTTGGTAAATCATTGTGA
AGTTCAGATTCATTATGGAGAGTTGATGTGCAGTAAGCATGATGTTTAACAATTTTAACACCAAAATGTTAATCCTGCATAAATC
AACTGTAATAATAAATAGGTGTTTCTGTATAGATAGAATGCATAGAGTACCTTAGTAAATCTTTGAATCACAATCTTTTGGCTGAA
ATGGAAGATTCTGTTAAATACTTTGAATAAACTTGGGGGAGGGAAATAAAATTGCAGAAAACTGCAGAGCACTAAAACTTAAAGA
AGGGCTACATCTTTATCCAGAAACCTGTTGCTCTTTTGCACGGAATGTTTAAATTCAGAGTTGGGATGGGGGTTGGGGTGAAGCAC
ACTTATTATCTTCAGTTGCAGTGATTTCAAATTTAGGATTTTTTGTTGTTGGTTTGAACTGTCCCCCTTAGTTTCTTGTTATTTCCA

TABLE 1-continued

Sequences Table. First column: SEQ ID No. Second column: corresponding mRNA sequence. For the 3 different groups, see explanation in the text.

```
    ATTTGTTCTGCTTAGTCATTACTTTTAATTCTTTTCTTACTAAAATTTTATGGTGGTTGGGGGAAGGGAGTTAGCATCACTAACCT
    GACAGTTGTTGCCAGGAATTTGCTTTGTTTACTGCTAGTATATTAGAAATCCTAGATCTCAGAATCACAATAGTAATAAACAACAG
    GGGTCATTTTTTCCTAACTTACTCTGTGTTCAGGTGTGGAATTTCTGTCTCCCAAGAGGAAATGTGACTTCACTTTGGTGCCAATG
    GACAGAAAATTCTACCTGTGCTACATAGGAGAAGTTTGGAATGCACTTAATAGCTGTTTTTACACCTTGGTTTTTACACCTTGATTTCGAGGTGGAAAG
    AAATTGATCATGAATCTCTAATAAATTTAAATCTCTTAAACCAGTAGGTGCTTAATATTTTTTGATTTGATTAATGCCCATTTAAA
    TCTCATGGGTTCTATTAAAAATATATATATAGGGCCCCAATCCATTGCCATCAAATTGCCCTTGGACTTTTCCAAGGTATATTA
    TGGGGTTTTATGCAAAATTCCAAGCTACCATGTAACTTTTTTTAACCATTTAACAAGGAGGGGGAACTGTTTCCTACCTTCTTTAC
    ATGTTGTGCATTGTTGTGGTCCAGAAATGCCAAACCTTTTTAAAGATGGTGCAACTTTGAGTCCTTGGCTTGACTATACAGGCCTT
    GAACTTCATGGCATATCAACTTTGCCATATCTGCAGGAGAGCTGTTCTATAAGAAATAGCTCAGAGTTGCAAATATCACATGTGAA
    TGATACGGTAACTTTTAAGAAATGTCTGTATTGTATTTGAAGACTGTTTGCCATAAATCTGAAATTTGAACCTATGTATTTCAATT
    TGGTATGCTAAAAAGTTCTGAATTAATGTAAAGTTTTTTGTTATAATATTGTAATCTCAGTTCAAAAGTTAACTGCAAATATAAAA
    CCCAATGATTTCTATATAGTAAATTGAACTGTAAAGGTAACTTGTGTGTGATTCTGAATACATAGATAAATGTTTTTATTCCTCAT
    GTTTTACTTTGGCTTCTATCTGAAATAGAGGTAAAATTTTACATATCA

109 CCCCTTTTAGAAGCTATACATAAAAAGTTGTTTTCCTTCTGTACTGTCACAGAACTTTTACATACATTCTCAGTCCTAGTTGTGAA
    AGGCCTAAAGAGAAAGAAACTCAATTTGCAGTCCAACACAAAGGGGGAATTTCTAAAATAAATAATCCAACAGTTTTTTGCATTT
    TTTTAAATTAATTTTTCATTTTTTTAAAATAAAATAACCAAAAAGTGTAAAGTTACAAAATGTCGTTGAAGAATAATATATTA
    AAACTGTGGAAAAAAAGGAAAAAGACACGTCACAAAATTTTAAGATTAATATGAAGATCATAATTTAACATAAAAGAATATATTCT
    ATGGATTTGTCATCCCGATAAATATGAACAAAATTAACAAAAAAAAGCATAGTTTGGCAATAAATACGTTTTGATAAGTTAAATAA
    GCTTTTTTATATTGATGTGCAGTGACAAGCAAAATTTTTGCTCTCCAATTTCTGAAAGTTATATGAAGTTTAAAACCCAGGGAAGA
    AAGCATGG

110 CTTTCGTGGAAAACCGATGGGGAACCTGGCCCCAAGGCTGGTCCCCAGGGAACGGGCAGCCCTTCAAGAGGAGCTTATTGACGT
    CCTCATCTACCTGGTGGCATTAGCAGCCCGCTGCCGTGTGGATCTGCCGCTAGCAGTGCTCTCCAAAATGGACATCAACCGGCGAC
    GCTACCCAGCCCATCTGGCCCGCAGCTCTTCCCGCAAGTATACAGAATTGCCCCATGGGGCCATCTCTGAAGACCAGGCTGTGGGG
    CCTGCCGGACATTCCCTGTGACTCCACAGGCCAGACCTCAACCTAGAAAGATGGCCACAGGACTTGCAACTCATGGTGGTGTCTGAA
    CAGCAGAGAGTGGCCTGGCCCTGGAGCCTTTTTCTAGTCTTTTCAGAATAGATCATGGGCCTGAGGCCTCCACTTCTTGAGGTCTG
    AGGCCCCACAACCTCTAGAAGGTACCCTCCTGCCGCCTGCTCTCCCACCCAAATGGTTTTGGGGCGATCCCTCCCAGAATATTCCT
    TGAATGGCCAGGGGAAGATCTCCTGTCTCCCCCCGCCCAAAACCGGGGTAACCAAGGGGTCCCCTCTGGAAAACCCCCCCCCGC
    GGTCTCCCCTTGCCGTAACCTATTTGCCCCGCCGTGGGCCGAAAACCATCTTGGGTTTCCTAACCAAAATTCCCCCGAAGGGATG
    GTCCATTGTAAACCCCCTTTCCCCCCTTCTTTAAACCAATTGAAATGGTTTGTTATGAAGTTCCCCAATCGCCGGGACCCCCAC
    CGCCCGCAATGGGGCCCCAAAAAGGTCCTTTCTTTTGAACACCTTGTCACCGCCTAAAATTGGAACATTAACCCCAAATTTAAATC
    AGTTTCCCGGAAATTTCAAACCTCCCCCGCCCCCTTTCCCCCTCCCCCGCGAAATATTTATCCCCGCCCCTCACACCGTTACA
    ATTGCCGCTTAAATATAAATTGGCCCCCTCTTTAAGCGGGTTTTTAAATGCCCCTTATTCCCCATATACATACAGGCCACTGTCC
    CCCCCCCCCACCCTTTCCCCCCCACCCCCGTTTTTTCCGTAGACACCCCTCTTTTTTTTTTCCCCCCCAATAGGGAGGTAAAAT
    CCTCGGACCAGGTCTCCTCCCATAAAAAACTGAGGATCCCCGAATAAAATCTTCTCCAAAAAAGACCCACCCCGGGTTTAAACTC
    TGGCATACCACCGCCCACCCCAATCTTTCTCGATTTCCCCCCCCCGGCGTAAATCTTTACCACCCCCCCCATAAAATTTAAGCCC
    CCCCCGCCCTTTTTTT

111 GGGTGTAGACAATGGGCAGCTGGGCGGTGTGGTGTAGACAGTGGAGCAGCTGGGCGGTGTGGTGTAGACAGTGGAGCAGCTGGGCT
    GTGTGGTGTAGACAGTGGAGCAGCTGGGCTGTGTGGTGTAGACAGACAGTGGAGCAGCTGGGCTGTGTGGTGTAGCCAGTTGCTCT
    TAGGCTGTTTTTCCTGTTGCTTCAGGCCTAAATTTGGACAGTGTGTGACTGTGCTGACTAATGTGGGCAGTTGTAACACAACAGCA
    AGTATTTGTGTATCTAAACATAGAAAAGGTGATGTGTTGTGCTCCGATGTTACAATGGCTACAACATCATTAGCAATAGGAATATG
    TCAGTTCTGTTATAATTTTATGGAACCACTGTAGTATATGCAGTCTGTAGTGTACCGAAACACCATCATGTGACACATGTATGTAT
    ACAGTGGATATACACAGGTGATCTGCAAATATTATGCCATTTTATGTCTGAAACTTCAGCATCCTCAAATTTTGGTAGCTGTGGGA
    GGTCCTGGAACTAACCTCCCATATATACCAAAGGATGACTGTATATAAAACTAGCTCTATAGAAGTTGGAAATCTTTCTAAAATTGAG
    GCTAACTCTGAAGTTGACTTCCTTTTCACATTATTTTCCCTCTTGATTTGTTTTAATCATTAACCTTATTTCAGATTTTTTGTATT
    AGATATCAATATCTCCATCATCACTGACTCCTGACACACGCATTCACACACACACACACCCAGACCCTATGTGGGTCTAGAACTTT
    GTATTAAGTAGCTGTTTAAACACTTTGTGTACATTCTGCAGTATGCTTGAACTCTGTTGAAAGTATTTCAGTGGTCCCCGTGTGGT
    GGCTCACTCCTGTAATCTCAACACTTTGGGATGCCAAAGCAGGCAGATCTGTCTGAGGTTAGGAGTTCGAGATCAGCATGGCCAGCA
    TGGCAAGACTTCGTCTCTACTAAAAATACAAAAATTAGCCTGGCATGGTGGTGCACGCCTGTAGTCCCAGCTACTTGGGAGGTCAA
    AGCAGGAGAATCACTTGAACCCAGGAGGTGGGGGTTGTAGTGAGCTGAGATTGCACCATTGCATTCCAGCCTGGGCAACAAACGA
    GACTCCCTCTCAGAAACAAAAAGTATTTCAGTAAAATCTATGTATTTGAAATAGAGTCACATAGAAAGTAGAGCACATGGGATCT
    TCAAAATATATTGGGTAGAAAAATCAGAAAACAAAAATTATAATTCATTCAGAAATAAGGAGAGGAAGAAGAAAAAGGGAATAAAAACT
    TCAAGGTCAGACTATGTAAAGGTGCCCTGAAGGATACAAAGATTAGAAAGCTTAGACGCTGCTGGATATAGATATGTAAAAGTGTG
    AGTCAGAATACTGAAAGTACCCTAATAAGTGCTTTACGTTGTAATCACATGGGAGGGATAAATGGGGGTTCAGAAAATTAATGTTT
    GATGCACTAAGGTAGGAATGGGCCAACTATGGCCTATAGGCCAAATCTGGCCTGCTGCCTGTTGTTACGTCCTGTGAGCGAGTGT
    TTTTCTCATATTTAAACGGATGGAGAAGAATCAAAATATTTTGTGACACATGAAAATTAAATGTAATTCAGTGTCCATAAATATTG
    GCATGCACCCACACTCAGTTTACATACTGCCCAGTTCACCTATTGCCTGTGACTATTTTAGTGTTACAGAGGCAGAGTTCATACTC
    TCTGGCCCTTCACAGAAAAAACTTGCCAAGCACTGCCTTAAAGCATCTATTGAATATAACGAATTAAGTCTTCTCCTGTTTATCTA
    GAATGATATCAGCTAAGTACTGTCCTGGGGGAAATTGACAAAACTCATACAAATAATTTTTCTGATAACCCAGGAGCTTGGGTTGA
    GAAAAACTGGATTAAGTCTTACTGTGACATTGGTAGAAAGGTTATTGAATGTCTGGCACGAGTTGTGCCTTGAAAAAATGGATTTC
    AACCAAGATTGGCCTGTGGCAATCTTGAGCAACTATGCAGGACAGGCAGTGGGAAAAACAATTCAGGATGGCATGGGAGCACAT
    TCTAGAGATTACAGAAGCTGGTGTAGAAAAGCAGGATGAAAAGTTAGGTTGGGGCCAAAAACCAGAAGAAGAAAGTACACTGGAAA
    AAGGATTGAGTATCAAGTGCTGCAGAGGATCTCAGAGGTCAAGAATTTAGAGCGGAACGTTGAGCTTGGCCTTCAGGAGCATGACT
    GTGATAAAAGGCCAGCTGTGAAACCTGTAGGAGAAATGATGACCCAGATAGTGCTGAGCAGCCGGCTGGCAGCGTTCTTGGGGTCC
    CTGTGGGGATGCAGGATGGTACAACTGCAGATGGGGAAGCAGCATCATTATTAACCTGTGTTTATATGACATTCAGAAAATATAT
    GATGGCCTTTCTTTCTTTTTCCTTTAATATTAGTGTTCTAGAACAGATCAGACATTTTGTAATGATGCCTGAAATAAACACTAAC
    CACCTCGACAAGCAACAGGTTCAACTCCTGGCAGAGATGTGTATCCTTATTGATGAAAATGACAATAAATTGGACTGAGACCAA
    GAAGAATTGTCACCTGAACGAGAACATTGAGAAAGGTGCTGCTTTGAAACAGTCTTTCTTGTAAAGCGATTTGTGTAGGCATTTCC
    GATTTGCTGAGAAGACACTCTGTTCAAGGAAGTGCAGTCTTCAGTAATACCGTATTTTCTGTTGGTTCCAGTTCGTTAAAGTAGT
    GTGGTCATTAGCATCTGCTTTGCTGTCTTCCTGTTACAGCGATTTCTCTTCACTTCATGCCTGTTACTCGGCTTCTTCAGAGTTAT
    TCTGGATTCATAGAAGAGGGACTAGCCCTGACATACAGCAGCAGCCTAGCCTCTAATATTTCTAGAGAGTGGAGAGAGGCGGGCAC
    CATGCAGGGAAGCGTGTGCCTTCACCACTTTCCGAGAACTGAATGTCCTTGATAGGGAACTTGACTGCCGGAAAGGGGCCACCAGC
    ATCACCATTTCCTTCACTCGACGGCCAACTTCCTTGCCCAGTGCAGAGCTCTTCCTCACCATAGCCATGCAGAGACTATGCATGTG
    GATAAACCATGGGAAAAAGCAAAAGCAGCAGCAAGTTACTAATGTTATTCTGAACTGCAGGGAGAGAATTTGGCAAATAACTGGTA
```

TABLE 1-continued

Sequences Table. First column: SEQ ID No. Second column: corresponding mRNA sequence. For the 3 different groups, see explanation in the text.

CTTAAGGCTAAAATAATTGTTATTTCTTTTGCTTTCAGGATTATTGCATCGAGCTTTTAGTGTCTTCTTATTCAACACCGAAAATA
AGCTTCTGCTACAGCAAAGATCAGATGCTAAGATTACCTTTCCAGGTTGTTTTACGAATACGTGTTGTAGTCATCCATTAAGCAAT
CCAGCCGAGCTTGAGGAAAGTGACGCCCTTGGAGTGAGGCGAGCAGCACAGAGACGGCTGAAAGCTGAGCTAGGAATTCCCTTGGA
AGAGGTTCCTCCAGAAGAAATTAATTATTTAACACGAATTCACTACAAAGCTCAGTCTGATGGTATCTGGGGTGAACATGAAATTG
ATTACATTTTGTTGGTGAGGAAGAATGTAACTTTGAATCCAGATCCCAATGAGATTAAAAGCTATTGTTTATGTGTCAAAGGAAGAA
CTAAAAGAACTTCTGAAAAAAGCAGCCAGTGGTGAAATTAAGATAACGCCATGGTTTAAAATTATTGCAGCGACTTTTCTCTTTAA
ATGGTGGGATAACTTAAATCATTTGAATCAGTTTGTTGACCATGAGAAAATATACAGAATGTGAATATGTAGGTAAATGATTACAG
AAAAATTTATCTGCTTAACAAACTTAGAATGACTTTTTCCTTTTAAATTTAGTTCTATCATTAATTTATCATTAAATTTAGTTCTA
TCATTTGGTACTATCATTAATGTATTATATACACTGATACTTTAAAACTTGTGTGGAAAAAACTAACTTATAATTTTGTATCACAC
ACCCTGGATATGTGTTCTGTTTCTAAGCGACATTTGTGAGAGATTATTGTAAAATGAGAGCGAGCAAATAAAACTTAATTTAATCT
TTGCAGATACATACTTATGGGAAATTTGAACAAATGAGTGAAACTCTGTGTTTTTAGTAGGCTGTGATAAACATTTCCGGAGCACT
TGCAGAGGACTTGCTATTTGCCAGGTGCTTTATGTATCATTAAATTTTTCTCATAGTTCAGAAAAATGTGCAAAGGAAACTATTGT
CTCGCTCCTTCAAAACAGTCTTAATTAACTTTCATATTAGCAGATTAAACTACAGAGCAGGTTCAAGGGAAATTAAATGATATGG
ACCCTAATTTGTATCATTCTGAGTTGATTGTGTGGTTTATTCATTCTGGAAACATGTTGATACTTACAGTCAGCCACTGCTTTTGA
TAAGTGATATTGATTAGGTTGAATCTTCTTGTAAATAGTATTTACCAGTTAGCAAAGTCTGTGTTTTCAGAATTACAGTGAGCACA
GAGGTGTTCATAAAATGGGAATTGAGTCCCACTCGGTAAGAGTTGCTTAAACTTGACACTGTTGACATTTGGGCTGGATAAAACCC
CTGTGGTGGGGTCTGTGCTGTGCATTGCAGGATGGTGAGCAGCGTCCCTCTCATGTGACACCCACAGTTATGCCGGATGTTGCCAG
ATGCCCCTAGGGGACAGAGTCAACCCCCAACTGAGGACCACTGTCCTACAGAGTCAGGAAATATTGTAGGGAGAAAAAAATAACAA
CAACAAAGGCCTGTGTTAATGTTAAATAGATGAGATTATGGAATGTGTATATTAATGTTAAAAATTGTACCTTGATCAATGTACTT
TTTATAAACTTGCCATAGATATCTCAGATTTGAAACCTCAAGACAGATTTATTATTCTTAAATGCTGTATGATAATGAAGAAAAT
AAAAATTTATTTCTTGCAAAGTTAAAAAAAAAAAAAAAA

112 GGTGGGGCATCCGGGTCTCTTGGTGGCTGCTTCTACCCCCGGAGCTCAGCTGATCTTCCCTTCCAGACTACGAGGTGTGAATTTCA
AACTTCCGTAATGGAGTTAGCCCACAGTTTATTGCTAAATGAAGAAGCTTTGGCTCAAATCACCGAAGCAAAAGACCAGTTTTCA
TCTTTGAATGGTTGCGATTTCTTGATAAAGTCTTGGTTGCTGCCAACAAGACCGATGTAAAGGAAAAACAGAAAAAACTTGTTGAA
CAATTAACTGGATTAATAAGTAGTTCACCTGGACCACCTACACGAAAATTATTAGCTAAAAATCTCGCAGCCCTTTATAGCATTGG
GGATACTTTTACAGTTTTTCAGACACTTGATAAATGCAATGACATTATCAGAAATAAAGATGACACTGCGGCCTACTTACCAACAA
AATTGGCTGCGGTGGCTTGTGTCGGAGCATTTTATGAAAAAATGGGGAGAATGTTGGGCAGCGCATTTCCAGAAACGGTAAATAAT
CTATTGAAATCTCTGAAAAGTGCAGAGTCTCAAGGGCGAAGTGAAATCTTAATGAGTCTACAGAAAGTTCTAAGTGGACTGGGTGG
TGCAGCAGCTTCCTCCCATCGTGATATTTACAAGAATGCCAGGTCTCTCTTGACTGATAGGTCAATGGCTGTTCGATGTGCAGTGG
CCAAGTGTCTACTAGAACTACAGAATGAAGCTGTATTTATGTGGACTGCTGAACTAGAAAATATAGCCACTCTCTGCTTTAAGGCT
TTGGAAAACTCAAATTATGGGGTACGAGTGGCAGTGTCTAAACTTTTAGGAACAGTCATGGCCACAGCATTAATGCCAAAACAGGC
AACAGTAATGCGTCAGAATGTGAAGCGAGCAACATTTGATGAAGTCTTAGAACTCATGGCCACAGGATTTCTGCGTGGAGGGTCAG
GTTTCTTAAAGAGCGGTGGAGAAATGTTAAAAGTTGGAGGGTCCGTTAACTCGTGAAGTGGAGATTGGAGTTACGCAGGCGTATGT
GTTTTTGTGACAACATTGGGTGGTCAGTGGTTGGAGCGCAGCTTTGCCACGTTCCTGTCCCATGTACTTGATCTGGTTTCCCATCC
TCGGGCAACACAAACACATGTGGAGGCTGTGTACTCCAGACGATGTGTTTCCTTTATCCTAAGAGCTACTGTGGGCAGTTTGCTAG
GTGAAAAAGCCCAGATTGCAGCTGCCAAAGAAATCTGCCAAGCTATTGGAAAACAAATGAAAGCCGTAGAAGCAGTAGTGAATGAC
ACAAGTGGAGAAAACAAATCTGGCGCAGCAGACATTGCAGCAAGTGCATGTGATGGTCTGTGCCCTCCAGGAACTCGGGAGCCT
GGTGCAGAGCTTGAATGCCACCGCATCCCCTCTTATTCAAGAAGCATCTATAGGGCTTTTGGAGATTGTGACTTCAGTGCTGCTTC
ATCCAAGCATGGCTGCCCGACTTGCTGCTGCATGGTGTTTGCGCTGTGGCTGTGGCATTACCTTTCCAGCTGACACCATTTCTA
GACAGGTGTGCAGAACGGCTCAACAACTTGAAGACCTCACCAGAAGCTGTCAGTGGATATAGTTTTGCAATGGCTGCTTTGTTAGG
TGGAGTACATCAGTGTCCTTTGGGCATTCCTCATGCCAAAGGAAAGATGGTAGTTAGTATTGCTGAAGATCTTTTACGAACTGCTG
CCCAAAATAGCAGGCTATCTTTACAGCGCACCCAAGCTGGCTGGCTTTTACTTGGAGCACTTATGACTTTAGGACCATCTGTCGTT
CGTTACCATCTGCCCAAGATGTTGTTATTGTGGCGAAATGTTTTCCCACGTTCCTTAAAGGAATTGGAAGCTGAGAAGGCCCGAGG
CGATTCTTTTACCTGGCAGGTAACTTTGGAAGGTCGTGCTGGAGCTCTATGTGCCATGAGGAGCTTCGTTGCACATTGTCCTGAGC
TACTAACTGAAGATGTGATTCGAAAATTGATGACCCCTATTGAATGTGCCATGACTGGACATTCCACACATTCCATCTGTAATGAAA
GCCCATGGAGCTCATCTGAAAGCTAGTGCTGCAATGGTCCGTTAAGACTTTATGATATCTTGGCTTTGTTACCTCCAAAAACTTA
TGAAGGATCTTTTAATGCACTTCTTAGAGAACTGGTAGCGGAATTCACTTTGACTGACAACTCAGCCAACACAACTACTTCCCTCC
TCAGATCCCTCTGCCATTATGATGATAGTGTTCTTCTTGGTTCTTGGCTTCAGGAAACTGATCATAAATCAATTGAAGACCAGCTC
CAGCCAAACAGTGCCTCTGGAAGTGGGGCTCTGGAGCATGATCCTTCCTCTATTTATTTACGCATACCTGCTGGAGAAGCAGTACC
TGGTCCCCTCCCTCTCGGAGTCTCAGTCATTGATGCTTCTGTGGCCCTTTTGGTGTAGTGTTTCCTCATGTTTCTTATAAACACC
GATTACAAATGTTGGATCACTTTGCTGAATGTGTTAAACAAGCTAAAGGTGTCCGCCAGCAGGCTGTGCAGCTTAACATATTTACT
GCTGTTCTTAGTGCACTAAAGGGCTTAGCTGAAAACAAAAGTACTTTAGGACCTGAGGAAGTTCGTAAATCTGCCCTGACACTGGT
TATGGGTCCTCTGGACAACCCAAACCCCATCTTACGTTGCTGCAGCGGGGAAGCTCTTGGAAGAATGGCTCAGGTGGTTGGAGAAG
CAACTTTTATTGCTAGAATGGCCCAATATAGCTTTGACAAGTTGAAATCGGCTCGAGATGTTGTATCTAGGACTGGTCATTCATTG
GCTCTTGGTTGTTTGCATCGTTATGTTGGTGGAATAGGCTCAGGACAACATCTGAAGACCAGTGTCAGCATTTTATTGGCTCTAGC
ACAAGATGGGACATCCCCTGAAGTCCAGACTTGGTCTCTTCATTCACTTGCTTTGATAGTGGATTCTAGTGGTCCGATGTATCGTG
GCTATGTGGAACCAACATTATCTCTAGTTCTTACCTTGCTGTTGACAGTTCCGCCTTCACATACAGAAGTTCATCAGTGTTTGGGT
CGATGCTTGGGTGCTATAATAACTACTGTTGGCCCTGAACTACAAGGGAATGGAGCAACAACTTCTACAATTCGTTCCTCTTGTTT
GGTGGGTTGTGCAATAACACAAGACCATTCAGATTCTCTTGTTCAGGCAGCTGCCATATCTTGCCTCAGCAGCTTCACATGTTTG
CACCACGACATGTCAATCTATCTAGCCTTGTTCCTAGCCTTTGTGTTCACTTATGTAGTTCCCATTTGTTACTTCGACGAGCAGCT
GTGGCATGTCTTCGGCAACTTGCACAAAGAGAAGCAGCGGAAGTATGTGAATATGCCATGAGCCTGGCAAAAAATACAGGGGACAA
AGAGAGCAGTAGTGCCAATGTCAGTCCTTTTGCCCCTCAGCCTGAACTGATATCCATTGCCCGGCACCAAGGTGTTAATA
TAACAGAAACTGGTCTTGAGGGACTTCTTTTTGGAATGCTAGACCGGGAGACAGATCGAAAATTATGTTCTGATATTCATGACACT
TTGGGACATATGCTTTCTTCGCTGGCAGTAGAAAAACTTTCTCATTGGCTAATGCTTTGTAAAGATGTCCTGGCAGCTTCTAGTGA
TATGAGTACTGCAACTCTCTTAAGTAGTGGAAAAGATGAAGAAGCTGAAAAGAAAGATGAGATGGATGATGATACCATGTTTACCA
CGTTAGGTGAAGAAGATAAATCAAAGCCCTTTGTGGCCCCTCGCTGGGCCACTCGAGTATTTGCTGCCGATTGCCTGTGTCGCAATC
ATCAATTTGTGTGAGAATGCAGACCAGGCTCACTTTGATCTTGCCTTGGCACGTTCTGCTAAACTTCGAAACCCTACAAATGACCT
CTTGGTACTTCATCTCTCTGACCTCATTCGCATGGCATTCATGGCTGCAACTGATCATCAACTGGCTCGCATCCCTGGGCTCC
AGGCGCTTGAAGACATTATCAAGAAGTTTGCGTCTGCCTGAGCCAGAATTTCCAGGTCATGTGATACTGGAGCAGTATCAGGCT
AATGCTGGGAGCTGCTCTAAGACCAGCCTTTTCACAAGATACACCATCAGATATAGCCGAAGCTGCCCAGGTATGTAGTACATG
GATAGGAAGTGGAGTTGTCAGTGATCTCAATGATCTCCGTCGAGTACACAATCTTCTTGTTTCTTCTCTGGACAAAGTTCAGGCTG
GAAAAGGATCTTCCAGCCAGCTGTACCGAGAGAGTGCCACGACCATGGAAAAACTGGCTGTTCTCAAAGCTTGGGCAGAGGTATAT
GTGGTCGCTATGAATATTAAAAAGGAAGCAGAGTCAAAACCAAAAAGAGCAATTAAAAATACTGACGATGATGATGACGACTGTGG
TACCATCGATGAACTGCCACCAGATAGTTTAATAACACTGGTACAACCTGAACTACCAACACTCAGTCGCCTGTGGTTAGCAGCAT
TAAAAGATTATGCACTCTTGACTTTACCAGCCGAATTTTCTAGTCAGCTTCCTCCAGATGGTGGAGCATTTTATACCCCTGAAACT

TABLE 1-continued

Sequences Table. First column: SEQ ID No. Second column: corresponding mRNA sequence. For the 3 different groups, see explanation in the text.

ATTGATACAGCTAGACTTCACTATCGGAATTCCTGGGCCCCAATTCTCCATGCGGTGGCACTTTGGTTAAATAGCACAGGATTTAC
GTGCTCAGAGTCTACAGAAGCAGCAGCAATATCTGGTTTACAAAAACGTTCTACATCTGTCAATTTAAACCAGGCATCAGGAGCAG
TGGGTAGTGCTAAATCTTTGCCAGAAATTAACAAAGACAGAATGCATCTGATTTTAGGTGTGAGTATACAGTTTCTTTGTTCCCCT
AGACCTGAGGAGCCCATTGAACATGTTACAGCATGCCTGCAGGCCTTACATACCTTGCTAGACTCCCCTTATGCTCGAGTCCATAT
TGCAGAAGATCAGCTGATAGGTGTTGAGTTGCTGAGTGTTTTGCACCGCCTTCTATTGACCTGGAATCCATCATCTGTCCAGCTGT
TGGTTACTGGAGTTGTACAACAGATAGTAAGAGCTGCTCAGGATTATTTGCAAGAGAAAGAAACACTCTAAATGAAGATGATATG
GAAAAGAGGCCTGTACCGTATTGGGAGAAGGAGGTGACAGCGGTGGTCTCATTCCTGGAAAATCTCTTGTGTTTGCAACTATGGA
GCTGCTGATGTTCATTTTAGTACGGCATATGCCACATCTCAGTACCAAGGTGTCAGACTCTCCAAGTCACATAGCCACTAAAACTC
GACTATCAGAAGAAAGTGCTCGTTTGGTGGCAGCCACAGTTACCATACTCTCTGATTTACCATCCCTTTGTTCACCCGCTGGATGT
ATGACAATCCTGCCCACAATTCTGTTCTTAATTGCAAGAATATTGAAAGACACAGCAATAAAGTCTGCAGATAATCAGGTTCCTCC
ACCAGTCAGTGCAGCTCTTCAAGGGATTAAAGTATTGTGACACTTTCAATGGCCAAAACTGAGGCTGGCGTTCAAAAACAGTGGA
CAGCTCTGATTCGTAGCACGCTTGCTTGCATCCTGGAATATTCTCAACCAGAAGACTCTGTACCTACACCTGATGAAGTAAGCATG
CTAACAGCAATTGCACTCTTCCTGTGGTCTGCTAGTAATGAAAATAGGAGTCCAGTCATTACAGAATGGCTGCATGAACAGATT
TAAAAATGCATTAAATTCATGCGACCCATGGGTTCAAGCCAAATGTTACCAGCTTCTCCTCTCAGTCTTCCAGCATTCCAATCGTG
CCCTTTCAACTCCTTATATTCATTCATTAGCTCCAATAGTGGTTGAAAAGCTAAAAGCTGTTGAAAGAAACAGACCAGCCAGTAAC
ATAGAGCTTTTAGCGGTTCAAGAAGGAATAAAAGTTCTTGAAACACTGGTTGCTCTTGGTGAAGAACAAAACAGAGTCCAGCTACT
TGCTCTTTTAGTTCCCACTTTGATATCTTACCTGCTGGATGAAAATTCTTTTGCCTCAGCAAGTTCAGCTTCCAAAGATCTTCATG
AGTTTGCACTCCAGAATTTAATGCATATTGGACCTCTGTATCCACATGCTTTCAAGACAGTAATGGGGGCTGCTCCTGAGTTGAAA
GTGCGTCTAGAAACTGCCCGTTCGAGCAAGCCAAGCGAGCAAAGCTAAAGCGGCTGCCAGACAACCAGCCCCCGCCATACATTCTGC
ACCAACAATTAAGCTAAAAACAAGTTTTTTTTAATTTGTAATTTCATTTATTTGTATTTATGTTGTCAACTAGCCCCTAATTAGTG
ATGGCCACTGTATCATTCCAGGCTACCTATGGGTTCTGTTTTATTTGTATATTGGTTCTTCCAAGTAGGTTAAGTGAA
ATAATGCTCACACCACTTATTGATTTTAAGGAGTGATTTTTTTTATCATGTGGTGAATATGTTTTCATTTTCCTCCTAATAATGT
TTCTCTTTTGTTAACTTATTTATTTTTCAAACACTGAGCCATAGTCTTAAATTTAAATGCTAAAACAATTGTATCATGTAGTCGG
GCAGCCTATTGATACTGTCAGGGGAAAAAAATGGGTCAGAACTCAGCATCTGTCATGAAAAAAATCAATTGAAAAACAAGCAGATT
TTAAATTTTGAAGTAATCAAAATAATGGAAAGTGTCTGTTTTGTGGTGTATATACTATGAATAAAATCACAGCATTTTCTAAGC

113 GGAGTGCACTGAAGATGGCGGCTGCTGTAGGACGGTTGCTCCGAGCGTCGGTGCCCGACATGTGAGTGCCATTCCTTGGGGCATTT
CTGCCACTGCAGCCCTCAGGCCTGCTGCATGTGGAAGAACGAGCTTGACAAATTTATTGTGTTCTGGTTCCAGTCAAGCAAAATTA
TTCAGCACCAGTTCCTCATGCCATGCACCTGCTGTCACCCAGCATGCACCCTATTTTAAGGGTACAGCCGTTGTCAATGGAGGGTT
CAAAGACCTAAGCCTTGATGACTTTAAGGGGAAATATTTGGTGCTTTTCTTCTATCCTTGGATTTCACCTTTGTGTGTCCTACAGA
AATTNGTGCTTTTAGTGACAAAGCTAACGAATTTCACGATGTGAACTGTGAAGTTGTCGCAGTCTCAGTGGATTCCCACTTTAGCC
ATCTTGCCTGGATAAATACACCAAGAAAGAATGGTGGTTTGGGCCACATGAACATCGCACTCTTGTCCAGACNTTACTTAAGCAGA
TTTCCCGAGACTACGGGGTGCTGTCAGCAAGTCTGGTCCTGCACTAAGAGGCTCTTCATAATTGACCCATGGGTCTCGAGCATTGA
GCGTAAGATTCCCAGGGCCAAAGGGGAAAAACTCGTGGGAGGGCGTGTAAACATGGAATGCCGCAGGACGGTCTCAAGCAGCCGG
TCACGATTAGGAAAACCGTCGTTCACACACAACTTCTTTTTCGGTTGTTTTTCCTTTCTCTATTGACGCATCTATGACACTCGTGN
GCACAGCAACCACACCACCACGCACACGCACAACAAGACCACACAACAAACACACGCACCACCACCAAGACACACAACGCAACAAC
ACACCAGCCGACACACACACCACAACCAACCACACACCAACAGCCACACAGCCACATACACAACGCAACCACACCGACAACCCAAC
ACACCCCAACCAGCAACAGCACCAGAGAAACCAGCACGACAACAGAGGAGGAGGAGACGCACAGGAGGGACGGCACGAACAATGGA
AGGGCGCACGGGGACCTGGAGCGGCACGCGGTGAGAGGCGAGGGACAAGAGGACGCACGAACGGCGCGCGGAGCCGAAACAGAG
GCGAGATAGACGGCCGGGAGCGCACACACAGAACGCGGGAGACGCGAGCGACGGTGACCGGAAGAAGACGAAACAGCAGAGAGGGT
ACGCCACGGCGCCCGCGACAAGGAAGGCAACACGAAGGAGACACAGCGACAGCAGAAGAGTGGCAGACACGAGAAGGAGAAGCAAG
CCACACAAGAGACAGGCGCCGAGGTACAGGACGGAGAGCCCAGAGGAGCGCAAGGCCGAGACACGAAGCGAAGACAACAGAGAAG
GAAGAGCGAGAAGACACACAGGGCAGAGACCCGGCAACAAAACAGACACAAAGCAGAACCAACGCAAAGCACAACCCCGCAGCAAG
ACGCAAGAGACACACAACACACCCACACCACAAAACGACCACACAACAACACACACCAAACACAACGAGACACCGGCGCAAACACC
AGGCCGGAGCAACAACCAGACGAGACATAGGAGCGGACCGCAGACCGCACGCCAGACGCCGTACGCAGAGAGACCGCGAGACACGG
ACACACGGACACGAGCGTCACAACGCGCACCGGCCGTTCAGGCCGACCGGAGACGCCCCGACGCACGACCGGCAGCGAAGCGAGAG
GGAAGGACGGAGAGCCACGAGACGGATGCAGAGGACAATACCGACGCAAGACGCGAGAGAACAGACGAA

114 GCCCCAGATCGGAAGTGACGGAGACGTGCTAGCGCGTCGAAGGTAGCTCTATGGTTTTCCTCGCGTTCTTGAGTCGGGAAATGGCC
GCTGTGTGGTTGCAACGGAGATAAATTCCCGGAACCGCGATTCGGCGTGTCAGGAATTCGAATTTAGAGTTTAATTTCTCAGAGCA
TTTCTCTCCAGGAAGAATTTTTACAGTATCTCAAAGACTTCACTTGACTTCTTGATCCTGCATAAAACCAAGGAGAAAGAAATGGG
TCGCTCCAATTCTAGATCACATTCTTCAAGGTCAAAGTCTAGATCACAGTCTAGTTCTCGATCAAGATCAAGATCTCATTCTAGAA
AGAAGCGATACAGTTCTAGGTCTCGTTCCAGAACATATTCAAGGTCTCGTAGTAGAGATCGTATGTATTCTAGAGATTATCGTCGC
GATTACAGAAATAATAGAGGAATGAGACGACCTTATGGGTACAGGAGAAGGGGTAGAGGGTATTATCAAGGAGGAGGGTAGATA
TCATCGAGGTGGTTATAGACCTGTCTGGAATAGAAGGCACTCTAGGAGTCCTAGACGAGGTCGTTCACGTTCCAGGAGTCCAAAAA
GAAGATCCGTTTCTTCTCAAAGATCCAGAAGCAGATCTCGCCGGTCATATAGATCTTCTAGGTCTCCAAGATCATCCTCTTCTCGT
TCTTCATCCCCATATAGCAAATCTCCTGTTTCTAAAAGACGAGGGTCTCAGGAAAAACAAACCAAAAAAGCTGAAGGGGAACCCCA
AGAAGAGAGTCCGTTGAAAAGTAAATCACAGGAGGAACCGAAAGATACATTTGAACATGACCCATCTGAGTCTATCCATCAATTTA
ATAAGTCATCAGCCACATCCGGTGATATTTGGCCTGGCCTTTCAGCTTATGATAATAGTCCTAGATCACCCCATAGTCCTTCACCT
ATTGCTACACCACCTAGTCAGAGTTCATCTTGCTCTGATGCTCCCATGCTCAGTACAGTTCACTCTGCAAAAAATACTCCTTCTCA
GCATTCACATTCCATTCAGCATAGTCCTGAAAGGTCTGGGTCTGGTTCTGTTGGAAATGGATCTAGTCGATACAGTCCTTCTCAGA
ATAGTCCAATTCATCACATCCCTTCACGAAGAAGTCCTGCAAAGACAATCGCACCACAGAATGCTCCAAGAGATGAGTCTAGGGGC
CGTTCCTCGTTTTATCCTGATGGTGGAGATCAGGAAACTGGGAAAGTTCTTAAAAAGGTTCACAGATGAAGATGCTAG
AGTATTCCTGCTTGATAGGGGTAATACCAGGGATAAAGAGGCTTCAAAAGAGAAAGGATCAGAGAAAGGGAGGGCAGAGGGAGAAT
GGGAAGATCAGGAAGCTCTAGATTACTTCAGTGATAAAGAGTCTGGAAAACAAAAGTTTAATGATTCAGAAGGGGATGACACAGAG
GAGACAGAGGATTATAGACAGTTCAGGAAGTCAGTCCTCGCAGATCAGGGTAAAAGTTTTGCTACTGCATCTCACCGGAATACTGA
GGAGGAAGGACTCAAGTACAAGTCCAAGTTTCACTGAAAGGCAATAGAAGAGGTGATGATTTAGAGAAGAAAAAATTATAAAC
TTAAAGAGACTGGATATGTAGTGGAAAGGCCTAGCACTACAAAAGATAAGCACAAAGAAGAAGACAAAAATTCTGAAAGAATAACA
GTAAAGAAAGAAACTCAGTCACCTGAGCAGGTAAAGTCTGAAAAGCTCAAAGACCTCTTTGATTACAGTCCCCCTCTACACAAGAA
TCTGGATGCACGAGAAAAGTCTACCTTCAGAGAGGAAAGCCCACTTAGGATCAAATGATAGCGAGTGATTCTCACCGTCCTGAAG
TCAAACTCAAAATGCACCTGTTCCTCTTGATGATTCTAACAGCCTTCCTTGACTAAAGACAGGCTGCTTGACTAGTACACTT
GTCCATTCTGTCAAGAAGGAGCAAGAATTCCGATCCATCTTTGACCACATTAAGTTGCCACAGGCCAGCAAAAGCACTTCAGAGTC
ATTTATTCAACACATTTGTGTCCTTGGTTCATCATGTTAAAGAGCAATACTTCAAGTCAGCTGCAATGACCCTAAACGAGCGGTTCA
CTTCGTATCAGAAAGCCACTGAAGAACATAGTACTCGGCAAAAGAGCCCTGAAATACACAGGAGAATTGACATCTCACCAAGTACC
TGAGGAAGCATACCCGTTTAGCAGGGGAAGAGAGAGTTTTTAAAGAAGAAAATCAAAAGGGAGATAAAAAATTAAGGTGTGACTC
TGCTGACCTTCGGCATGACATTGATCGCCGTAGAAAAGAAAGAAGTAAAGAACGGGGAGATTCCAAGGGCTCCAGGGAATCCAGTG

TABLE 1-continued

Sequences Table. First column: SEQ ID No. Second column: corresponding mRNA sequence. For the 3 different groups, see explanation in the text.

| | |
|---|---|
| | GATCAAGAAAGCAGGAAAAAACTCCAAAAGATTACAAGGAATACAAATCTTACAAAGATGACAGTAAACATAAAAGAGAGCAAGAT<br>CATTCTCGATCTTCATCCTCTTCAGCATCACCTTCTTCTCCCAGTTCTCGAGAAGAAAAGGAGAGTAAGAAGGAAAGAGAAGAAGA<br>ATTTAAAACTCACCATGAAATGAAGAATACTCAGGCTTTTGCAGGAGTTAGCCGACCACGAGGAACCTTTTTTCGAATTAGAGGCA<br>GAGGAAGAGCCAGAGGAGTTTTTGCTGGGACAAATACTGGTCCAAACAACTCAAATACTACTTTTCAAAAGAGACCGAAGGAAGAG<br>GAATGGGATCCAGAATATACCCCAAAGAGCAAGAAGTACTTCTTGCATGACGACAGAGATGATGGTGTGGATTATTGGGCCAAAAG<br>AGGAAGAGGTCGTGGTACTTTTCAACGTGGCAGAGGGCGCTTTAACTTCAAAAAATCAGGTAGCAGTCCTAAATGGACTCATGACA<br>AATACCAAGGGGATGGGATTGTTGAAGATGAAGAAGAGACCATGGAAAATAATGAAGAAAGAAGGACAGACGCAAGGAAGAAAAG<br>GAATAATAAATATGAAGTAAGATTACAACAGAGCAGAACTTGCACCCACCATTTTTTTACCTGATTTTTGTTTTCAAATAAGAAT<br>GTAAGCATTTTACTTAAATTTTACTGTTTGCAAGTAGTCTATAGAAATTTTGTTTTAAGTCTTCAAATATCTTGAGAAATAGTAGA<br>CTGTATGTTGAAAATTGTACTGAAATAAAGTAGAAAATTGTTACGTACCATATTTGTAACTATCAACTTTTAAAACTTTTAACGTT<br>TTTGTTACATGCATTGTAATTCTGCTTTGTCTATAAGATATGGTCAAGTACAGCTCTGTGAAAGTTCTGATTCTCTTCCTTCCCTG<br>TTTGTCAATGTTTTATTCTGAAGTAAACGTTAGCTCTACATATAAATCCTGGAACAGAAATTGTTTATAGAGACTACACTAATTAT<br>TTTAACTGTATACATCTGTTTAATTTGAACACACTACATCGTAGGGTGACTGATTTTTGAAGTATACCACAGACAAAAAGTTGTTA<br>CTATGGTAAACTAAGCTAGTTTAACACTTGAGCAAATGCTTAAGAAGGAATTAAAAAAAAAAAGCTTTGCCAATAGCTAAAAAGTA<br>CAAGCTATTAAAAATCAGATTGAAAAGTTTTGAGAAAATGTTATTTTTACTGAAAGCAAGCAGTGGCCTATAAAGAACATTCTTAG<br>GAGCCTTTTCTATTTGCGTTCAAAACTGTGTGTTCTCTTTCTATTCCTATTTGATAGTTTGAGTCATGGTCTTAGATATTAGCTAT<br>TTGTGAGAGGAAACTGGTTTGTAACAATACTGCAAATAGAAACCCATTTCTACTGAACATCCTAGTTTTAAACAGAAGAAAAACT<br>GTAATCCTGGGGTTGGTATGTAGGAGGTCTATCCTGCAGAATAAGTTGATACATTAGTACCTGATTTCATATCTTACATATTTATT<br>TGAGCTGAACATTAGTTTGTAGTGTAACTATTAGTAAAAATAGAGAAACACAGCATACTGTTCATTAATAGTATTTTAAAAAAATT<br>GTTTTTCAAATGTCACCAATAAAAGTTTTGGCAGGAAGCTTGTTGCGGCATTGATCTAACCTTTTTCCCCCCCATTTCAGTTGCAG<br>TTTTTGTAGAATGGCTTTTCTTTTTCCTCTTAAGAGTTCTATTCTTCAGGTAGATAATTTTTCAAATGTGAATTATCTTTTGTGT<br>CTATATTGATAGCTCTTAAAGGAGTGAAAATCTAAAATAGTAAATTTCAATGTTAAGTGTCTGCTTTATGGGCATATATAAAAGTA<br>GACACATTTCATTTGTTTAATTTAGTTGTGTGTGTGTTAAAAGGAGCTAATGCTTATTCTGTTAATGTAAACTTTTGAAGATCTT<br>AAGTGTATTGCTCTTTCATCTTAAACACTTTCGAGGATTTGCAGTGCGTCTAGCACCTAGATTACAGCCAGGAACATTGGTTAAGA<br>ACTGTTGGAAACAAAACTAAAAGCAAACTCAACATATGTGATGTTTATGGCCCTCAGATCCTTAGTATTGTGTGATTTTCCCCCGT<br>TAACATGTCTTTCTAAAATTGTCTATTAAAGCAGAGGAAATACCTGCCAAAGGAAGTATGTATTGCATTAATCAGGGCATAACTAA<br>TATTCTCCTGTTCAGAATAATACTTATTTACGTGTGAAAGCAACATGGATGTGATTCCCAACACAGAATTTTCATGACCCTTTTAT<br>TGTATACAAATAAATACCATAACAGTTACTTGGTTAGACATCAAATCTGTGTGCATGACTATGTGCTTATCCACTTAAGACAATAG<br>GTAAAAGGGGATCTGAGAAATTATGTAATAGGGAGTGGGAATAAAATACTTAATTCCTGTGGGCAGGTTATATTTAAGTTCAAA<br>TGCATTGCTTTAACCTTTGGTTACTTTTATTCTGTTAAACAGAATTGAAGAAAGATATTATACCAGAGTGTAGTAGGCTAGGGTG<br>ATTGTAAGAACTCTGTAATAGAATGTCATTGTGGATGTTACCTTTTTCAGATCCAAGCATATAAAAAGCCTGTATATTTTTAAAA<br>ACACATCTTAACTCCACGCTTTACGATATTATAAAAGTTGAATGGTTCCTCTTGGTAAGGATATTTGCTTACAAGTGCTAGGAAAT<br>AACTCACTGATACCTGCGTTAACATACTTTGTTTTGCCTAGAGAGGGGCAATAAAAATGAACCAAAGGATATTTCCAGAAAGGATT<br>AAGAAAGCTGTTTAAGAAGGCCATGACTCTTTAGGTGTGTATGTGTACCTTTCAGCATCCTAGGAATTTTTATACTAAAAGCAAAA<br>TGTTTTTTCCAGTTAGTCTTCTTCAAGGAATTACTATTGTTCCTTTTGTCACAGGTAAAATCAGTGTTGGGAATTATAATTTGAGA<br>AAAATATTACCCAGTAACATTGAATGTAGATGGCTAAACGATTCTTACTCAGTGTGATGTATAATGATGCAACAGGGACCCTTGTA<br>AATTGTCATACGCCAATAAAATGTCACAAGTAAT |
| 115 | AAGTTGACTAATGTGACAGTGTAGTTTAATTGGTGCAGTGAGTAGCAGAAATCGGTTATACTGGTTTGATCAAAAGTTTGACCTGT<br>TTACACTTTATGAACAGACTCTCTTTCGATTGCTGGAATTCTGTTGTAACGAATCAACCCTATATATCCTTAGAATGCTCCCTTG<br>CATTCAGTAACCATAGCTGTGCATGTTATAATGTATGTGCATGGAAGGTGGCTCTACGGGGTGATTGAGGGACTATTACTGGACA<br>AAAGAGATCAGGTTAAAGGCTGTTGATTCATGGGCTGCTATATTACTGTCCAAACCACCCTTTGCATTTGGAACTACGTCTTGGTT<br>AGAGGGGGGAAAGTAGCACTTTTTGAGAACCTTGAAGAAGTGGGAGACTGTTCAACAGCTGCCTGTATCTCAGTGGTGGCCAGTAA<br>ACTGAAACAAGTTTATAAGGGAATAAAAATCAACCAGTGACAAGGGGTTCTAATGTTAAATGCATATATTGGCAAAATGCCAGTAG<br>GGCTATGTAGGGTGGTGAGCACTCACAATTGTTCACTAAAATGCTGTTTTTAAAACAGGAAAGTAGAATGGTTGAGTGCAAATCCA<br>TAGCATGAGATAAATTGAGCTTCTTAAGGCAAATCAGCCTAGGCAAATTCATTTCCGTGTTTTTGTGTATTTGGAGATGCCAGCTC<br>GTCACTCAGCCCATGGAGCTTACAGGTCCTGATCACTTGATCTAATTGTATGGATGTGGTAGTTTGTCTTCCCTGGGGCAGAAAAC<br>AAAGCTTTAATTTGGAACTAAAATTGTTATTATTTTGCATCTAAAGGTATGAGTTTATAGACTTTTGATGTTAGATTTTAAATTA<br>GAAGGTCACTGAAAATTTCCCTTAAAAATGACCCCAACGAATTTGTGTATTTTGTATAAATTGGTTTGTTATATTAAAGCATACAT<br>ACATAATCTATATGTGATTATGTATTCATTAGGAATCAAACTGAATTTTGACCCATTGATGCACAGCACTGAATGTTGTGGAATGTA<br>ATTTTTGTTTGTTTTTGTTTCTGTTTTTTGAGGCAGAGCCTTGCTCTGTCGCCTAGGCTGGAGTGCAGTGGCGCAATCTCAGCTCA<br>TTGCAATCTCTGCCTCCAGGGTTTAAATGATTCTTGTGCCTTAGCCTCCTGAGTAGCTGAGATTACAGGTGCTCTACCACGCCTGT<br>TTAATTTTTGTGTGTGTGTGTGTGTTTTTTTTTTGTAGAGACAGGGTTTCACCATGTTGGCCAGGCTGGTCTCGAATTGCTG<br>ACCTCAAGTGATCCACCCGCCTCATGCCTCAGCCTTACAAAGTGCTGGGATTACAGGCATGAGCCACTGCGCCTGGCCGGGAATG<br>TATTTAAAGATATAACACAAGTATATAACTGAATACCATTGTGAAACATTAATTATCAATGTTTTATTGTGTCTTTTAGGTGTTGA<br>AATTCCGTAAACTTAACTTCAATGGGGAGGGTGAACCCGAAGAACTGATGGTGGACAACTGGCGCCCAGCTCAGCCACTGAAGAAC<br>AGGCAAATCAAAGCTTCCTTCAAATAAGATGGTCCCATAGTCTGTATCCAAATAATGAATCTTCGGGTGTTTCCCTTTAGCTAAGC<br>ACAGATCTACCTTGGTGATTTGGACCCTGGTTGCTTTGTGTCTAGTTTTCTAGACCCTTCATCTCTTACTTGATAGACTTACTAAT<br>AAAATGTGAAGACTAGACCAATTGTCATGCTTGACACAACTGCTGTGGCTGGTTGTTTATGGTAGTAGTTTTTCTGTA<br>ACACAGAATATAGGATAAGAAATAAGAATAAAGTACCTTGACTTGTTCACAGCATGTAGGGTGATGACACTCACAATTGTTGAC<br>TAAAATGCTGCTTTTAAAACATAGGAAAGTAGAATGGTTGAGTGCAAATCCATAGCACAAGATAAATTGAGCTAGTTAAGGCAAAT<br>CAGGTAAAATAGTCATGATTCTATGTAATGTAAACCAGAAAAAATAAATGTTCATGATTTCAAGATGTTATATTAAAGAAAAACTT<br>TAAAAATTATTATATATTTATAGCAAAGTTATCTTAAATATGAATTCTGTTGTAATTTAATGACTTTTGAATTACAGAGATATAAA<br>TGAAGTATTATCTGTAAAAATTGTTATAATTAGAGTTGTGATACAGAGTATATTTCCATTCAGACAATATATCATAACTTAATAAA<br>TATTGTATTTTAGATATATTCTCTAATAAAATTCAGAATTCT |
| 116 | AAAATCTTGTGGGAAGAGCTGAAGCAGGCGCTCTTGGCTCGGCGCGGCCCGCTGCAATCCGTGGAGGAACGCGCCGCCGAGCCACC<br>ATCATGCCTGGGCACTTACAGGAAGGCTTCGGCTGCGTGGTCACCAACCGATTCGACCAGTTATTTGACGACGAATCGGACCCCTT<br>CGAGGTGCTGAAGGCAGCAGAGAACAAGAAAAAAGAAGCCGGCGGGGCGGCGTTGGGGGCCCTGGGGCCAAGAGCGCAGCTCAGG<br>CCGCGGCCCAGACCAACTCCAACGCGGCAGGCAAACAGCTGCGCAAGGAGTCCCAGAAAGACCGCAAGAACCCGCTGCCCCCCAGC<br>GTTGGCGTGGTTGACAAGAAGAGGAGACGCAGCCGCCCGTGGCGCTTAAGAAAGAAGGATAAAGACGAGTTGGAAGAAGAACCTGA<br>TCAACAACTTCAGGGTGAAGGGAAAATAATTGATAGAAGACACCAGAAAGGCGACCACCTCGTGAACGAAGATTCGAAAAGCCACTTG<br>AAGAAAGGGTGAAGGAGGCGAATTTTCAGTTGATAGACCGATTATTGACCGACCTATTCGAGGTCGTGGTGGTCTTGGAAGAGGT<br>CGAGGGGGCCGTGGACGTGGAATGGGCCGAGGAGATGGATTTGATTCTCGTGGCAAACGTGAATTTGATAGGCATAGTGGAAGTGA<br>TAGATCTTCTTTTTCACATTACAGTGGCCTGAAGCACGAGGACAAACGTGGAGGTAGCGGATCTCACAACTGGGGAACTGTCAAAG<br>ACGAATTAACAGAGTCCCCCCAAATACATTCAGAAACAAATATCTTATAATTACAGTGACTTGGATCAATCAAATGTGACTGAGGAA |

TABLE 1-continued

Sequences Table. First column: SEQ ID No. Second column: corresponding mRNA sequence. For the 3 different groups, see explanation in the text.

ACACCTGAAGGTGAAGAACATCATCCAGTGGCAGACACTGAAAATAAGGAGAATGAAGTTGAAGAGGTAAAAGAGGAGGGTCCAAA
AGAGATGACTTTGGATGAGTGGAAGGCTATTCAAAATAAGGACCGGGCAAAAGTAGAATTTAATATCCGAAAACCAAGTGAAGGTG
CTGATGGGCAGTGGAAGAAGGGATTTGTTCTTCATAAATCAAAGAGTGAAGAGGCTCATGCTGAAGATTCGGTTATGGACCATCAT
TTCCGGAAGCCAGCAAATGATATAACGTCTCAGCTGGAGATCAATTTTGGAGACCTTGGCCGCCCAGGACGTGGCGGCAGGGGAGG
ACGAGGTGGACGTGGGCGTGGTGGGCGCCCAAACCGTGGCAGCAGGACCGACAAGTCAAGTGCTTCTGCTCCTGATGTGGATGACC
CAGAGGCATTCCCAGCTCTGGCTTAACTGGATGCCATAAGACAACCCTGGTTCCTTTGTGAACCCTTCTGTTCAAAGCTTTTGCAT
GCTTAAGGATTCCAAACGACTAAGAAATTAAAAAAAAAAAGACTGTCATTCATACCATTCACACCTAAAGACTGAATTTTATCTGT
TTTAAAAATGAACTTCTCCCGCTACACAGAAGTAACAAATATGGTAGTCAGTTTTGTATTTAGAAATGTATTGGTAGCAGGGATGT
TTTCATAATTTTCAGAGATTATGCATTCTTCATGAATACTTTTGTATTGCTGCTTGCAAATATGCATTTCCAAACTTGAAATATAG
GTGTGAACAGTGTGTACCAGTTTAAAGCTTTCACTTCATTTGTGTTTTTAATTAAGGATTTAGAAGTTCCCCCAATTACAAACTG
GTTTTAAATATTGGACATACTGGTTTTAATACCTGCTTTGCATATTCACACATGGTCAACTGGGACATGTTAAACTTTGATTTGTC
AAATTTTATGCTGTGTGGAATACTAACTATATGTATTTTAACTTAGTTTTAATATTTTCATTTTTGGGGAAAAATCTTTTTTCACT
TCTCATGATAGCTGTTATATATATATGCTAAATCTTTATATACAGAAATATCAGTACTTGAACAAATTCAAAGCACATTTGGTTTA
TTAACCCTTGCTCCTTGCATGGCTCATTAGGTTCAAATTATAACTGATTTACATTTTCAGCTATATTTACTTTTTAAATGCTTGAG
TTTCCCATTTTAAAATCTAAACTAGACATCTTAATTGGTGAAAGTTGTTTAAACTACTTATTGTTGGTAGGCACATCGTGTCAAGT
GAAGTAGTTTTATAGGTATGGGTTTTTTCTCCCCCTTCACCAGGGTGGGTGGAATAAGTTGATTGGCCAATGTGTAATATTTAAA
CTGTTCTGTAAAATAAGTGTCTGGCCATTTGGTATGATTTCTGTGTGTGAAAGGTCCCAAAATCAAAATGGTACATCCATAATCAG
CCACCATTTAACCCTTCCTTGTTCTAAAACAAAAACCAAAGGGCGCTGGTTGGTAGGGTGAGGTGGGGGAGTATTTTAATTTTTGG
AATTTGGGAAGCAGACAGCTTTACTTTGTAAGGTTGGAACAGCAGCACTATACATGAAATATAAACCAAAAACCTTTACTGTTTCT
AAATTTCCTAGATTGCTATTATTTGGTTGTAAGTTGAGTATTCCACAGAAGGTGGTAATTATCTCTTCTCTCTTCCTCCATTAGAA
AATTAGGTAAATAATGGATTCCTATAATGGGAGCATCACCACTTATTAAAACACACATAGAATGAATGATGAATTAAAAAAGTTTTCTAG
GATTGTCTTTTATTCTGCCACATTTATTGATAAACAGTGAAGGAATTTTTAAAAAATTTTTAAGAATTGTTTGTCACGTCATTTTT
AGAAATGTTCTACCTGTATATGGTAATGTCCAGTTTTAAAAATATTGGACATCTTCAATCTTAAACATTTCTATTTAGCTGATTGG
TTCTCACATATACTTCTAAAAGAAACTTTTATGTTATAAGAGTTACTTTTTGGATAAGATTTATTAATCTCAGTTACCTACTATTC
TGACATTTTAGGAAGGAGGTAATTGTTTTTAATGATGGATAAAATCTTGTGCTGGTGTTTTGGATCTTTATGATGCTGAGCATGTTCTG
CACTGGTGCTAATGTCTAATAATTTTATATTTACACACATACGTGCTACCCAGAGATTAATTTAGTCCATATGAACTATTGACCCA
TTGTTCATTGAGACAGCAACATACGCACTCCTAAATCAGTGTGTTTAGACTTTTCAAGTATCTAACTCATTTCCAAACATGTACCA
TGTTTTATAAACCTCTTGATTTCCAGCAACATACTATAGAAAACACCTGCTACTCAAAACACAACTTCTCAGTGTCATCCATTGCT
GTCGTGAGAGACAACATAGCAATATCTGGTATGTTGCAAGCTTTCAAGATAGCCTGAACTTAAAAAGTTGGTGCATTAGTTGTATC
TGATGGATATAAATTTGCCTCCTAGTTCACTTTGTGTCAAGAGCTAAAACTGTGAACCTAACTTTCTCTTATTGGTGGGTAATAAC
TGAAAATAAAGATTTATTTTCATGCTCACTTCTTAAAAGTCAT

117 CGCGGGCCACTGTCGGGGCCGCTGCTCGGGCGGCGCGGGGTCTGCGCTGGGGCCATGGCTCCGCCGCGCCGCTTCGTCCTGGAGCT
TCCCGACTGCACCCTGGCTCACTTCGCCCTAGGCGCCGACGCCCCGGCGACGCAGACGCCCCGACCCCCGCCTGGCGGCGCTGC
TGGGGCCCCCGGAGCGCAGCTACTCGCTGTGCGTGCCCGTGACCCCGGACGCCGGCTGCGGGGCCCGGGTCCGGGCGGCGCGGCTG
CACCAGCGCCTGCTGCACCAGCTGCGCCGCGGCCCCTTCCAGCGGTGCCAGCTGCTCAGGCTGCTCTGCTACTGCCCGGGCGGCCA
GGCCGGCGGCGCACAGCAAGGCTTCCTGCTGCGCGACCCCCTGGATGACCCTGACACCCGGCAAGCGCTGCTCGAGCTGCTGGGCG
CCTGCCAGGAGGCACCACGCCCGCACTTGGGCGAGTTCGGGCGCGACCCGCGCGGCCAGCTGTGGCAGCGCCTCTGGGAGGTGCAA
GACGGCAGGCGGCTGCAGGTGGGCTGCGCACAGGTCGTGCCCGTCCCGGAGCCCCCGCTGCACCCGGTGGTGCCAGACTTGCCCAG
TTCCGTGGTCTTCCCGGACCGGGAAGCCGCCCGGGCCGTTTTGGAGGAGTGTACCTCCTTTATTCCTGAAGCCCGGGCAGTGCTTG
ACCTGGTCGACCAGTGCCCAAAACAGATCCAGAAAGGAAAGTTCCAGGTTGTTGCCATCGAAGGACTGGATGCCACGGGTAAAACC
ACGGTGACCCAGTCAGTGGCAGATTCACTTAAGGCTGTCCTCTTAAAGTCACCACCCTCTTGCATTGGCCAGTGGAGGAAGATCTT
TGATGATGAACCAACTATCATTAGAAGAGCTTTTTACTCTTTGGGCAATTATATTGTGGCCTCCGAAATAGCTAAAGAATCTGCCA
AATCTCCTGTGATTGTAGACAGGTACTGGCACAGCACGGCCACCTATGCCATAGCCACTGAGGTGAGTGGGGGTCTCCAGCACCTG
CCCCCAGCCCATCACCCTGTGTACCAGTGGCCAGAGGACCTGCTCAAACCTGACCTTATCCTGCTGCTCACTGTGAGTCCTGAGGA
GAGGTTGCAGGGCTGCAGGGCCGGGGCATGGAGAAGACCAGGGAAGAAGCAGAACTTGAGGCCAACAGTGGTGTTTCGTCAAAAGG
TAGAAATGTCCTACCAGCGGATGGAGAATCCTGGCTGCCATGTGGTTGATGCCAGCCCCTCCAGAGAAAAGGTCCTGCAGACGGTA
TTAAGCCTAATCCAGAATAGTTTTAGTGGACCGTAGTTACTCTGGCCAGGTGCCACGTCTAACTAGATTAGATGTTGTTTGAAACA
TCTACATCCACCATTTGTTATGCAGTGTTCCCAAATTTCTGTTCTACAAGCATGTTGTGTGGCAGAAAACTGGAGACCAGGCATCT
TAATTTTACTTCAGCCATCGTACCCTCTTCTGACTGATGGACCCGGTCATCACAAAGGTCCCTCTCATCATGTTCCAGTGAGAGGCC
AGCGATTGCTTTCTTCCTGGCATAGTAAACATTTTCTTGGAACATATGTTTCACTTAATCACTACCAAATATCTGGAAGACCTGTC
TTACTCAGACAGCACCAGGTGTACAGAAGCAGCAGACAAGATCTTCCAGATCAGCAGGGAGACCCCGGAGCCTCTGCTTCTCCTAC
ACTGGCATGCTGATGAGATCGTGACATGCCCACATTGGCTTCTTCCACATCTGGTTGCACTCGTCATGATGGGCTCGCTGCATCTC
CCTCAGTCCCAAATTCTAGAGCCAAGTGTTCCTGCAGAGGCTGTCTATGTGCTCTGGCTGCCCAAGGACACTCCTGCAGAGCCATT
TTTGGGTAAGGAACACTTACAAAGAAGGCATTGATCTTGTGTCTGAGGCTCAGAGCCCTTTTGATAGGCTTCTGAGTCATATATAA
AGACATTCAAGCCAAGATGCTCCAACTGCAAATATACCAACCTTCTCTGAATTATATTTTGCTTATTTATATTTCTTTTCTTTTTT
TCTAAAGTATGGCTCTGAATAGAATGCACATTTTCCATTGAACTGGATGCATTTCATTTAGCCAATCCAGTAATTTATTTATATTA
ATCTATACATAATATGTTTCCTCAGCATAGGAGCTATGATTCATTAATTAAAAGTGGAGTCAAAACGCTAAATGCAATGTTTGTTG
TGTATTTTCATTACACAAACTTAATTTGTCTTGTTAAATAAGTACAGTGGATCTTGGAGTGGATTTCTTGTAAATTATCTTGCA
CTTGAATGTCTCATGATTACATATGAAATCGCTTTGACATATCTTTAGACAGAAAAAGTAGCTGAGTGAGGGGGAAATTATAGAG
CTGTGTGACTTTAGGGAGTAGGTTGAACCAGGTGATTACCTAAAATTCCTTCCAGTTCAAAGGCAGATAAATCTGTAAATTATTTT
ATCCTATCTACCATTTCTTAAGAAGACATTACTCCAAAATAATTAAATTTAAGGCTTTATCAGGTCTGCATATAGAATCTTAAATT
CTAATAAAGTTTCATGTTGATAGGATTTTTAAAAGACTTAGGTAATTTCTATATAATATGTATATTAAAATGTAATT
GATTTCAGTTGAAAGTATTTTAAAGCTGATAAATAGCATTAGGGTTCTTTGCAATGTGGTATCTAGCTGTATTATTGGTTTTATTT
ACTTTAAACATTTTGAAAAGCTTATACTGGCAGCCTAGAAAACAAACAATTAATGTATCTTTATGTCCCTGGCACATGAATAAAC
TTTGCTGTGGTTTACTAAAAAAAAAAAAAAAAAAAAAAA

118 GCCCGGAGAAGCAGGCTCAGGAGGGAGGGAGCCAGAGGAAAAGAAGAGGAGGAGAAGGAGGAGGACCCGGGAGGGAGGCGCGGCG
CGGGAGGAGGAGGGCGCAGCCGCGGAGCCAGTGGCCCCGCTTGGACGCGCTGCTCTCCAGATACCCCCGGAGCTCCAGCCGCGCG
GATCGCGCGCTCCCGCCGCTCTGCCCCTAAACTTCTGCCGTAGCTCCCTTTCAAGCCAGCGAATTTATTCCTTAAAACCAGAAACT
GAACCTCGGCACGGGAAAGGAGTCCGCGGAGGAGCAAAACCACAGCAGGACAGGAAGCTTCAGAGAGCAGCCTTCCCGGAGCAC
CAACTCCGTGTCGGGAGTGCAGAAACCAACAAGTGAGAGGGCGCCGCGTTCCCGGGGCGCAGCTGCGGGCGGCGGGAGCAGGCGCA
GGAGGAGGAAGCGAGCGCCCCGAGCCCGAGCCCGAGTCCCCGAGCCTGAGCCGCAATCGCTGCGGTACTCTGCTCCGGATTCGT
GTGCGCGGGCTGCGCCGAGCGCTGGGCAGGAGGCTTCGTTTTGCCCTGGTTGCAAGCAGCGGCTGGGAGCAGCCGGTCCCTGGGA
ATATGCGGCGCGTGGATCCTGCTCACCTTGGGCTTGGTGGCCTGCGTGTCGGCGGAGTCGAGAGCAGAGCTGACATCTGATAAA
GACATGTACCTTGACAACAGCTCCATTGAAGAAGCTTCAGGAGTGTATCCTATTGATGACGATGACTACGCTTCTGCGTCTGGCTC

TABLE 1-continued

Sequences Table. First column: SEQ ID No. Second column: corresponding mRNA sequence. For the 3 different groups, see explanation in the text.

```
   GGGAGCTGATGAGGATGTAGAGAGTCCAGAGCTGACAACATCTCGACCACTTCCAAAGATACTGTTGACTAGTGCTGCTCCAAAAG
   TGGAAACCACGACGCTGAATATACAGAACAAGATACCTGCTCAGACAAAGTCACCTGAAGAAACTGATAAAGAGAAAGTTCACCTC
   TCTGACTCAGAAAGGAAAATGGACCCAGCCGAAGAGGATACAAATGTGTATACTGAGAAACACTCAGACAGTCTGTTTAAACGGAC
   AGAAGTCCTAGCAGCTGTCATTGCTGGTGGAGTTATTGGCTTTCTCTTTGCAATTTTTCTTATCCTGCTGTTGGTGTATCGCATGA
   GAAAGAAGGATGAAGGAAGCTATGACCTTGGAGAACGCAAACCATCCAGTGCTGCTTATCAGAAGGCACCTACTAAGGAGTTTTAT
   GCGTAAAACTCCAACTTAGTGTCTCTATTTATGAGATCACTGAACTTTTCAAAATAAAGCTTTTGCATAGAATAATGAAGATCTTT
   GTTTTTTGTTTTCATTAAAGAGCCATTCTGGCACTTTAATGATAAAATCCCATTGTATTTAAAACATTTCATGTATTTCTTTAGAA
   CAACATAAAATTAAAATTTAACATCTGCAGTGTTCTGTGAATAGCAGTGGCAAAATATTATGTTATGAAAACCCTCGATGTTCATG
   GAATTGGTTTAAACTTTTATGCGCAAATACAAAATGATTGTCTTTTTCCTATGACTCAAAGATGAAAGCTGTTTCATTTGTGTCAG
   CATGTCTCAGATTGACCTTACCAAGTTGGTCTTACTTTGTTAATTTATCTGTTGTCCCCTTCCTCTCCTCTGCCCTCCCTTCTTGT
   GCCCTTAAAACCAAACCCTATGCCTTTTGTAGCTGTCATGGTGCAATTTGTCTTTGGAAAATTCAGATAATGGTAATTTAGTGTAT
   ATGTGATTTTCAAATATGTAAACTTTAACTTCCACTTTGTATAAATTTTTAAGTGTCAGACTATCCATTTTACACTTGCTTTATTT
   TTCATTACCTGTAGCTTTGGGCAGATTTGCAACAGCAAATTAATGTGTAAAATTGGATTATTACTACAAAACCGTTTAGTCATATC
   TATCTAATCAGATCTTCTTTTGGGAGGATTTGATGTAAGTTACTGACAAGCCTCAGCAAACCCAAAGATGTTAACAGTATTTTAAG
   AAGTTGCTGCAGATTCCTTTGGCCACTGTATTTGTTAATTTCTTGCAATTTGAAGGTACGAGTAGAGGTTTAAAGAAAAATCAGTT
   TTTGTTCTTAAAAATGCATTTAAGTTGTAAACGTCTTTTTAAGCCTTTGAAGTGCCTCTGATTCTATGTAACTTGTTGCAGACTGG
   TGTTAATGAGTATATGTAACAGTTTAAAAAAAAAGTTGGTATTTTATAAGCACAGACAATTCTAATGGTAACTTTTGTAGTCTTAT
   GAATAGACATAAATTGTAATTTGGGAACATAAAAACTACTGAATAAATCATGTGGCCTAATATTGAAAATGTCACTGTTATAAATT
   TTGTACATTTTTGATCAAATGTACATCTCCCCTTTGCTAACGGCCGTCTGCTCTCAAGGATGACGTGGGTTTGATTTCTAAGTGTT
   TCACAGTGTCTGTAAATCAAGACCAAAGAGCCTGTCGATGAGACTGTTTATTACCAGATTCACTTCTGAATTGGCCAGAGGAAATC
   TGAATGTATTATCCTGTGTGTGTCTAGGTAGAGATATTGGAAGGCTGCCAGGGGATTTCGAAGTTTGCAACCTTTATAGGATAACT
   GATGGCAATATTAAGACAGACGCCTGCTTTTGCAAATAACTTACAAGACTGTAAATTCCAAAGATCTGAATGGGGCTTTCCTGATG
   TTGGTATCTAAGGCTTAGGCCTATAGATTGATTTACCTTTGGAATTGTGCTCCAAATGTCTACTGAAGCTTAACCGAAGAACTAAT
   AAATGGACTACAGTAGCTCACGTTACAGGGAAGGAGGGTAGGCAGGGAGGCTCTGTGTGTTAAAATGAGGGTCTCACTGCTTTAGG
   ATTGAAGTGGCTGGAAAGAGTGATGCCTGGGGAAGGAGATGGAGTTATGAGGGTACTGTGGCTGGTACTTTCTGTACTAAACATTT
   CCTTTTTCTATTTTACCACTAATTTTGTTTTAAACTGTGAGCCGTCCAAGTCAGAAGAAGACAGCAAAAAAAGCAACTTTTCCAAC
   ATACAATTTACTTTTAATAAAGTATGAATATTTCATTTGAGAACATTCCCTGGAATTGCCACATAATTCATTAAAAACATTTTTT
   TAAGCAACACTTGGAACAGTGTTTACTTTAAATCCTTAATGGCCTTAATTAATTCTCAGATTCCTGCCCCATCACTTACAGAACCA
   ATTCACTTTAGAGTGACTAAAAGGAAACGATAGCCTAGCTTTCTAAAGCCACGCTGTGTCCCTCAATTACAGAGGGTAGGAATGGG
   TATACCTCTAACTGTGCAAAGCAGAGTGAAATTCAATTCATAGAATAACAACTGCTGGGAATATCCGTGCCAGGAAAAGAAAAATT
   TCTGGCAAATATTTTGTCACTGCTGTAAAGCAAAATATTTGTGAAAGTGCCAAAATAAAGTCTGTCATGCCAAAAGTAAAAAAAAA
   AAAAAAAAAAAAAAAAAAAAAAAAAAAAAAAAAAAAAAAAAAAAAAAAAA

119 GGACGCCGGGGCCCGCCATCCCCAACGTCCACCGCGAGCTCCCCAGATCCATGGTCTGGAGCAGGTCCAGAAGACGCACCTGGCAG
   GACGCCCCGGGCGCCACAGTCGCCCTCCACACGGGCCACCCCAATCCTGCCGCGGCTCCGTGGCTCTCCTTACCTTTACCTGAGGT
   GAAGCAAGGACGTGGAAGCAGCTACGGCGCGCTACCAAGCACCTCACACCGCTCTCAACAGTACTGCTCAGCCTCCCGGCCCGCCG
   ATGCGCAGGCGACAGCAGCCAACTTGATGCTCTTCACTTCTTACAAATTGGCATGCCAGGCTGCTGCTCAGGTAATCTGCCTCTTG
   GACCGGCTCTGAAAATGGGACAATGATCAGTGCAAGATCCCTGAGATGCTGCAAGCACGATGGGATGGAAGAAAGCTATGGGACAAG
   TGGCCTTTCATAGGAGGAGGAGCTCCTTGTCAAATGTGAGGAGCGAAGCAGGACAGGAGGCATGAGAACAGGAAGCCAGAAGTTATG
   GGACACTCAAGCAGCACTAGGGAGAGGCTCATGAGTAGAAGAACTGAGGCATCCCGCAAACAGCCATGGACTAACCTGTATTGGG
   AGCAGATTCTCCAGCTCCACGTCTGTTCCTTAGTCTCTGTTGAGGTGAAACTCCAATATCTGAACCCACCAGCCAAATAAGCAACC
   TGTGTACAAGCCAAGTTAAAATTTCACTCCCGTAATGAGTGGATGGCAGAACCATTTCTCATGCACAGGGAGTGCATGAAT
   CCCCTGAATTGCCAGGTTTCAGGGTCACATGAGACCTCTAGAAAGGCTCTGCTCATCATCACCTTATCATCTGCTGATATACCTATT
   CTAACGAAGGAGGGAGAGGAGTAATGCACAAGAAACTCAGGCCAATGGGGGAGCAAGAAGAAAACGAAGAAGTGCAGTGCATGCGT
   CATCGGTGTTTAACAGTCAGAAGCGAAACAGTTCAGAACAAGGCCTGCCCTGTCAAAAGAAGAGCTAAAGACAGTTATATAAAAAT
   TAAGAATAACTCAATCTCAGTGTGACTACTGATCCGCCGCCACGTGGCTTCCCGGACACACTGCTGCAGCGCCAACAGTGGAGAGG
   AGCTCTCCATCACAACCAGACAGCAGAAGCACAGCACAGTGAAGCACACCTGCCCACATGATGCACAATACAGGTATTCATTTACA
   ACAGATAGATTTTATGCCCTGTACAGGTATGAACACAGTGAAGATTTGACGATGGTCTCTCTTTCAGCTGAACTCTGGAGTTTTAA
   TTACTGACATTTTCTTGGAAGAAATTATCCTTTGTGGTTTTAAAACATGTGGGCTTTTTTTTTGTTGCTCAAGTCACATGTTCTA
   ACAAGACAGTTTTAATAAGCCAGTTTGACTAGATGTAAAGTACTTGGATTAAAGTGATAATCTTACTTTGTGGCCTATAAATTAAC
   ACGTCTGAATTTCTTTTTAAGAATTCAGAAACCAGTAACTTCCAAACAACTTGAAATTGAATAAATATTTTCAGCAACCCAGGGGT
   GAACTAAATGCAACAGATTACTCAACTTTAAAAAGTCTTACTTACTGTACAGATTTTCCATATTAAACATCTGGTATGCCTCAATT
   TTTTACTTAAAAGTCTCGGACTTTGAGAGCATACAGCATTTTTTGCACATATATAACCATGATGTACTTTAATATTCCAATCTTAG
   GTTGTGATTTTAGAGGTTGTTTTGGTATCATTAAATACCAATGGGACCAAACCAGAAAATTAAATAAAAATATAATTCACCACTCA
   CACACCCTTAAGGGTCTAGATTCAATTTCCAAAAGCATAATATTGGGTAGTTACTTGCAGTTGTGAAAATAATTTCAATCTTGGAA
   TCTTGGTACACAGTCCCAAAATTTAAAAAAAAAAAAAAAAAAAAAGGAAATCCACTGTAATCCCAGTGTCTTTAAAATAATGCTGC
   CAGCCCGACCCCACCTCACCCTACAGTCAACCAGTTACCATGGTTCAGGATAGGACAAACTTAGGTTTTGGACAAATGAAGAGTTC
   AATGGCTGTTAATTGTCACAGGCAGAGAAAGAAGGAAAACCAAAAGTTGATAAATGTTAACTCAACAATTATAGTCTTTACACAGC
   TTGCCTTAAAACTGCTCCAGTTCAGACTTACTCTGTTCAAAAGTGAATATACAGACGTTAGTGTATCTCTCTATTTAAATCTCAG
   TCTCAGTACTAATCTTCTACCTCCATGAAACATACACAACAAAACAAAAGGAAGAGCTAGGGATTTGGGAAGAGGCACTTCCAGAA
   AAAAAGAAAGTGACGATTATTTCAGATTTGAATTTACCATTTTTTACCATTTTTTCTGTTTCAAGGTCCCAGATAATATACATTTCT
   TCATTAATTATTCATTTTCTGAGTGCCTACTATGGCTGGAGTACTCTATTCGATTTCAAGCTTAGAGAGAGATTGAAACAGAAACA
   GTAACAGTCCCTGCCCATCTCACCCTTCATTAACTTGCTGTGTGGAAGACAAGCATACAGCTGGACCCTCATGAGGCAATGGTAG
   TAGGGCCCACAGGGAGGTGTGCTACTGAAGCACCCTGAGGGCCTGGAGCCCACCATGCCCGTGGAGAGGGTGCTCCTGAGGGAGAC
   AGAGTTCTGTGCGTTCTCCCTATGGAGTCCTGCATTTACTAGATTTCAATCCTCTTCCCCTGACTGATTTCAATCCACACACCCTC
   CCACTATTTTTTTTTTTTAAATAATAATAGGCTTTCTGCCCCAACTAAAGGAATTTTAGGCTTCTGCAACAAGTGGAGGAGGCA
   TTTTGAAGATGGGACACAAAGAAGTCTTCTTTCTCCAGATCCAGAATGTCAGGCCTTGTAAGAATTCAAGCCAAAAAAGTTCATCC
   ATGGGAAAAACGGTTCTTCTATCATCCAGCACGTATTTGTGCCAACAGAGCTGAGGGACTTGAGTAATTCAAGAGGCTAGGGTTG
   GGGGCAGACGTGTCCAGTGGCTCCCACAGCCCCGCCGTCCTGAAAGTCACGCAGTTAATGTGCCTCGGGTGGATCAGCCCTCC
   CGACAGATGACTACTAGGGAATTAATCCCCAGTTAATAATGTGCTTTGGACCAAGTAAGTCAAGATTATTTTTCCTACAATTATAC
   AAAGATATGCTTTTCCAGAAGGGAACTTCTGGAAAAATAAACATATGCTTAAAATATTATTCACATATTTAGAGAAGAA
   AGAACTTAAAATAGCAGAAGACCTGAATACCATGATCCACGGTGCCCACCCCTGGGAGCATGTCTTTGTGTGAGACAAGACCTAGC
   ACAGCAGGGCTGGCTTTCTAAGGGTACGGTGAGGCACCACTGAACTCATCAAGGAACTATGCCTAGTCTTGCCCCTCTGGTTTATG
   TCACCAGTATCAAAGAGAGAGGACCTCTGGATGCCTGAATGAGGCAAGAACTAATGTGAAGGCCTCAGCTGCCTTAAGAGAATTAT
   GCCCTGATCTGGCACAGTGATGAATGTCTGTGGTTATACTGCTGCTGCCGCTGGTGTGCTGCTGGTGAGGTGGTGGGTGTGGGTG
   TCTTTTAAGGAAAGCGCTACTATTTTAGCTCTCTTCCACTCCAGCTCTACAAATCAGTGCAAGTCTAGTTCAGGCAGGGTCAAACC
```

TABLE 1-continued

Sequences Table. First column: SEQ ID No. Second column: corresponding mRNA sequence. For the 3 different groups, see explanation in the text.

```
    ATTTTGTTCACCTACTTTCCTGCCAGTGATTTCAACCTTGACCTTCAAAAATGCTCTGCAAGATTAAAAGTGATTTAAGATTGTTT
    TCTTTCAGTGCAAACTGCCAGTTGATACAACCTCTTCAGTTCCTGCCTGCCAGTATAAGATAGGGAATTGTTGATACTATTTAGTG
    TAAATAAAATAATTTCTTAAACATTGAAATACCAGTAACAGCTGGGGGAGGACTCACCGTTAGTCAATTACACTTATGAAACTTTC
    AAATAGAAATTTTATTTTCAGTGGATTCTGTTTTTCTTTCTTAACTGCAAAATCAGCAAGTCATTGGTTAAAAAGTATACTCTCCC
    CGCTTGAAGTCAAACAAGTATTCACCCTAAGAGGCAAAGTCCAGTATCTACAGTAAAAACTGACCTGACCTTTGGTATTCCGCAAG
    GGCCTGAACTTCCATTCCATTCCCAGTGCTGGATGTGGAGAATGGGTGATCCCAAGCAACAATCATTTGCCTTTCTGTCAAAAGCT
    GTCTCGGTTTAAATGTACTGTATTTTCTTTGCCTCTTCTTCTCATCGGAACATGTTCTAGTCTACTCGCCAGGTGCTACTTCTGGC
    AGTCAGAAATAGTGCCACTTTTCAACTTCAAGTTTCTTACCAACCTTTTTTGCATTCATGCAGCAAGAGTTCATGAAATAGCTGCA
    AAGTGCTGGACACTGTTAGGTTGTGGGAATTGCAAGAGAAACAGTTTCTGCCTTCTAGATGCTCACGTCTGGGGGTGGGGCAGGTA
    CAGCAGGGGTGATCAATCCACAAAAATTTACTTTTAAAAATGTGTTATGGGCTGACTTGTATCACCCCAAAATTCATATGGGGAAG
    TCCTAACCACCAATACCTCAGAATGTGATTGTATTTGGAAACAGGATCTTTGCAGAGGCAATTAAGTTAAAATAAGGACATCATCA
    GGGTGGGCCCTAATCTCAAGTGACCCATGTCCTTCTAAGAAGAGATTAGGACACAGATACACAGAGGAAAGACCATATGAAGCACAC
    AGGGAGAAGACAGCCATCTACAAGCCCAGAAGGGAGGCCTCAGAAGGATAAGCCAACCCTGCCAACATCTTGATCTCAGACTTCCAGCG
    TCCAGATTGTTAGAAAATAAATTTCTGTTGTTTAAGCTGCCCAGTCTGTGGCACTTTGTTATGGCAGCCCTCGCAAACTAAACACA
    GTGTGCTTTTTAAGGGCAACAACAAAAAGAAATATATAGGTTAAGTCAAATGTAATAGCTGCTGGAACATCTATCAACAGACTAA
    ACAACAAACAAAACCAACATTTAGCATAATATCCAGTAGTGCTGTCAACAAAGGAAATGGGGGTGGCAGTGAGCACATCTGGGAGG
    GCATTTGATGGCTGTCAGAATCAGCCAAGGAAGATGATAGAAGGTGAGGGATAAGTGCAGAATAAGCTCCATGCAGGCAAGTGGC
    CCTGTAGCCAGGTCTCCCTGCAGCTCCTAGGGGCCACAGCAGTAACAAGACCCACATGAACCCATGAGTTTCTGTGCCCTCAGTTT
    TCTAACTAGTTCAGAATATTAGGAACTGACAATGACCCTATCACTGAAGCTTTTGAGTGCTGATAATATGAGGGTCAGAAAACTGG
    TAAGCTGATCCATCTATCTAGAGTCCATCTGTGCTTGCTGAACTGTAAAGCTGCCCATTCTTCTTGGTGCTCATCAACTGACACTC
    CAAACATGGACACGTGGCTGATACTGCATTCCATTCATTCATTGTCTGAATTCAAGTTTGTGTTTTTCATGAAGGCCAATTAAATT
    AACTTTCTTTTTGACACTTCAAGAAAAAAAAAAAAAAAAAAAAACA
120 CCAGTGCAGGACGCGCTGACAGCTCGAGTGAGCGGACTGCCCAGGACTTCGGAACTAGACGAGTTCTGTAGAAATCCTGTCAAAGA
    ATATGAAGAAAAACAGAGAAAGATTCTGCAATAGAGAGAGAAATTTGTATATAAATTTAAAGTAGGAAGTCAGTGCTTAGAACTG
    AGAGTGCCACTCAAATTTCCTGTTCAAGAGAATGCCAGTCATTTGCATGGACGTCTGATGCTGCTGCACAGTTTACCGTGCTTTAT
    AGAAAAAGACTTAAAAGAAGCTCTGACTCAGTTTATAGAAGAAGAATCCCTCAGCGATTATGATAGAGATGCTGAAGCATCCCTGG
    CAGCTGTGAAATCAGGTGAAGTAGATTTACATCAGCTGGCGAGTACATGGGCCAAAGCTTATGCTGAGACCACGTTAGAGCATGCA
    AGGCCTGAAGAACCCAGCTGGGATGAAGATTTTGCAGATGTGTACCATGACTTAATTCATTCTCCTGCCTCTGAAACTCTCTTAAA
    TTTGGAACATAATTACTTTGTTAGTATCTCAGAACTGATTCGTCAAAGAGATGTGGAGCTGAAAAAATTACGAGAGAGACAAGGTA
    TTGAAATGGAAAAAGTCATGCAGGAATTGGGAAAATCACTGACAGATCAAGATGTAAATTCACTGGCTGCTCAGCATTTTGAATCC
    CAGCAAGACCTAGAAAATAAATGGTCGAATGAATTAAAACAATCAACTGCCATCCAAAAACAAGAGTATCAAGAATGGGTAATAAA
    ACTTCACCAAGACCTAAAAAACCCCAACAACAGCTCCCTTAGTGAGGAAATTAAAGTTCAGCCAAGTCAGTTCAGAGAATCTGTAG
    AAGCAATTGGAAGGATTTATGAGGAACAGAGAAAGTTAGAAGAAGTTTTACCATTCACTTAGGAGCCCAGTTGAAGACCATGCAT
    AATTTGAGATTGCTGAGAGCAGATATGCTGGACTTCTGTAAGCATAAAAGAAATCATCGAAGTGGTGTGAAACTTCATCGGCTCCA
    AACAGCTCTGTCACTTTATTCTACATCTCTCTGTGGCCTGGTTTTACTAGTAGATAATCGAATTAATTCATATAGTGGTATTAAAA
    GAGATTTTGCCACAGTTTGCCAAGAATGCACTGACTTCCATTTCCCCCGAATTGAAGAGCAATTAGAAGTTGTCCAACAGGTGGTA
    CTTTATGCTAGAACCCAGCGCAGGATGTAAATTGAAAGAATCACTTGATTCTGGAAACCAAAATGGAGGAAATGATGATAAGACTAA
    GAATGCTGAGAGGAACTATTTAAATGTTTTACCTGGGGAATTTTATATTACACGGCATTCTAATCTCTCAGAAATCCATGTTGCTT
    TCCATCTCTGTGTGGATGACCATGTGAAATCGGGAAACATCACTGCTCGTGATCCTGCCATTATGGGACTCCGAAATATACTCAAA
    GTTTGCTGTACCCATGACATCACAACAATAAGCATTCCTCTCTTGCTGGTACATGATATGTCAGAGGAAATGACTATACCCTGGTG
    CTTAAGGAGAGCGGAACTTGTGTTCAAGTGTGTCAAAGGTTTCATGATGGAAATGGCTTCATGGGATGGAGGAATTTCTAGGACAG
    TGCAATTTCTAGTACCACAGAGTATTTCTGAAGAAATGTTTTATCAACTTAGTAACATGCTTCCCCAGATCTTCCGAGTATCATCA
    ACACTCACTCTGACATCCAAGCACTAAACCCTTATAGATTGACATGCTGGCAGAAGATGATTGTTAAACTCTCCAGGAACTTGTGC
    TATGCTGGGAATCTGTCAAGCAAAAGATGCCCAGAAAGAGAACTTGCAGCTCAATCCACAAATCAAGATACATGTGTGTGAAACCA
    TTCCAAAAATTTATATACTGCACAAACTGGTGATCAACCCCTAACTTAAACACTTAAAGTCTCTTTATGAATTTCTCTTTTTTTCT
    TCTCTGTGTTACCTGTGAATATTAGTAATCTAAAACTTTTTATTTATCACACATGGACACTTGGGAAAGGAAACTTGATTATATTT
    ACATGGAGGCATTTGACTTTTTCAAGAGGCTTGACTCGTCTCAGGTGCAATCCTTAATTAAACATACAAACAAAATTTTCCTTTTA
    CTTTCTTTGCCAAAACAAAATGTAAAAGCACTGAAATATACATTGCAAGTACAAATTTCCTGTGAAAATCTTTTTATAGAAACACA
    AATGTATAAGACAAATGTGCTTGTTCTTTTAAATTCTCCTGTTTCATTGTTTTTCATTTAATCTACTCCTAAGGATGTACAAGTTAG
    AGTCAGAAGACGTTTTAGATTTTTTCCCTCTCTCATCCTCCCGCTGTGCCCTTGCACTTGCATATTAATAACATTTCATGGACT
    GGGAAATAGTGTTCTTTTTTGCAAGCTTGATGTCAAGTTAGTCTAAACCAGCACCTGGCAGTATTTTAGTGCTCATCAACATTGTG
    ACAATCACACAAGGAAGATCATTTCTACATTTCTGTCCTCCCTGCGTTCTCAGCTTGCTTAACCATTCCTCTACCTCTTGCATTTT
    TTTGCGGATAAATGTATCCCCATTTCTGCTTCTCTGTTTCCCCTCCTTTTCCATTGTTTTTCCTTATGGTACTACTTTCTCAGGTG
    CTACATATCATATATTTGTCCCATCTATAACATATTTAAATGCTATAAGTAGTAACTCCATTAAACAAAGGCATTTACAAAAGCAC
    ACAGGTGTTTAGAAAAGCAATAGTTTCATCAATTCCAAGTTATGTGGATATTGTAACTGGCCACAAGAATGAAATGGAGGGCATTT
    GGTGTCATAAGATGGCATGTCTTGATGACAAGAAACAAAACGCCCTTCATTAATATGCCTCAGTGTAATAACTATTATAGAAACTG
    TTGGCAAGCAGAGTGCTTTCCTATAACAGAATGTGTCTTAATTTTCTACTCGAGGGAAAGGTTTGTCCAGGTAACAACACTAAAGA
    CAACCCTAAGAACACCCACTCCAGCAGTATGTCCATTAGACACTAAAACTCTCCAAATTATTTGTCAGGGAGCCTGGCGATTCTGC
    CAAGAAGGCAGGTGTTTTGCCCTTAGAGCCTATACAGTTCTCTTGGAGAAATTGCTTTCAGGCACCACTGTTAATCACTGAGACT
    GATTCTAATGCAAAGCAGGGAAGACAGAGGCAGAAACCAGGAGAGTGGTAGATCAGTGCAGCCCAGATATCGGAATGGAGGAGCAA
    AGTTTCATTCACGGATGTTTGTTGAATGCTGCTGCCCAACTCTTCCTTTGTCACCTCTAGGCTATTCCACTAAGTTACTTATAAAC
    TGGTGGCTTTAACTGAGGGCTGTGTAAAGGTACTATTTGGCATGTGAAGTCAGGATAAATTTATCGAATGTCCGTTTTCCACATGC
    AACTGTGTTACAGAAGTAGTAAAATTGGAAGAATCATGTTTATGGTGTTACCACTGATGGAAACACAAACACCAAGCTAATAAT
    AAATATATAACTTAAAAAGCTAATTATATGCACTGAAATGGTGGGAATTTTAGTGATGCAGTAATTGAGGAGTCTGGAGTTTTGTA
    TTTGGACCAAGAATTATGAGATGAGGATCTTTTCTGAGTGTTCTAAAGGGCTTCTTGAGGGGGAGTGGTTTAAAGCACTTCATGA
    ATGATGTGAAGAAGGTACCTTGGGCTGACAGCATTCTAGGTACAGATGGCACTCTGTTCAACCAACTGTGGATGAAAATATTC
    TGAAAAAAAATACAATAAAATTTTAAAAATACAAAAAAAAAAA
121 ATAACGTCTTTGTCACTAAAATGTTCCCCAGGGGCCTTCGGCGAGTCTTTTTGTTTGGTTTTTGTTTTTAATCTGTGGCTCTTGA
    TAATTTATCTAGTGGTTGCCTACACCTGAAAAACAAGACACAGTGTTTAACTATCAACGAAAGAACTGGACGGCTCCCCGCCGCGA
    TCCCACTCCCCGAGTTTGTGGCTGGCATTTGGGCCACGCGGGCTGGGCGGTCACAGCGAGGGGCGCGCAGTTTGGGGTCACACAG
    CTCCGCTTCTAGGCCCCAACCACCGTTAAAAGGGGAAGCCCGTGCCCCATCAGGTCCGCTCTTGCTGAGCCCAGAGCCATCCCGCG
    CTCTGCGGGCTGGGAGGCCCGGGCCAGGACGCGAGTCCTGCGCAGCCGAGGTTCCCCAGCGCCCCTGCAGCCGCGCGTAGGCAGA
    GACGGAGCCCGGCCCTGCGCCTCCGCACCACGCCCGGGACCCCACCCAGCGGCCCGTACCCGGAGAAGCAGCGCGAGCACCCGAAG
    CTCCCCGGCTGGCGGCAGAAACCGGGAGTGGGGCCGGGCGAGTGCGCGGCATCCCAGGCCGGCCCCGAACGCTCCGCCCGCGGTGGGC
```

TABLE 1-continued

Sequences Table. First column: SEQ ID No. Second column: corresponding mRNA sequence. For the 3 different groups, see explanation in the text.

| | |
|---|---|
| | CGACTTCCCCTCCTCTTCCCTCTCTCCTTCCTTTAGCCCGCTGGCGCCGGACACGCTGCGCCTCATCTCTTGGGGCGTTCTTCCCC<br>GTTGGCCAACCGTCGCATCCCGTGCAACTTTGGGGTAGTGGCCGTTTAGTGTTGAATGTTCCCCACCGAGAGCGCATGGCTTGGGA<br>AGCGAGGCGCGAACCCGGCCCCCGAAGCCGCCGTCCGGGAGACGGTGATGCTGTTGCTGTGCCTGGGGGTCCCGACCGGCCGCCCC<br>TACAACGTGGACACTGAGAGCGCGCTGCTTTACCAGGGCCCCCACAACACGCTGTTCGGCTACTCGGTCGTGCTGCACAGCCACGG<br>GGCGAACCGATGGCTCCTAGTGGGTGCGCCCACTGCCAACTGGCTCGCCAACGCTTCAGTGATCAATCCCGGGGCGATTTACAGAT<br>GCAGGATCGGAAAGAATCCCGGCCAGACGTGCGAACAGCTCCAGCTGGGTAGCCCTAATGGAGAACCTTGTGGAAAGACTTGTTTG<br>GAAGAGAGAGACAATCAGTGGTTGGGGGTCACACTTTCCAGACAGCCAGGAGAAAATGGATCCATCGTGACTTGTGGGCATAGATG<br>GAAAAATATATTTTACATAAAGAATGAAAATAAGCTCCCCACTGGTGGTTGCTATGGAGTGCCCCCTGATTTACGAACAGAACTGA<br>GTAAAAGAATAGCTCCGTGTTATCAAGATTATGTGAAAAAATTTGGAGAAAATTTTGCATCATGTCAAGCTGGAATATCCAGTTTT<br>TACACAAAGGATTTAATTGTGATGGGGGCCCCAGGATCATCTTACTGGACTGGCTCTCTTTTTGTCTACAATATAACTACAAATAA<br>ATACAAGGCTTTTTTAGACAAACAAAATCAAGTAAAATTTGGAAGTTATTTAGGATATTCAGTCGGAGCTGGTCATTTTCGGAGCC<br>AGCATACTACCGAAGTAGTCGGAGGAGCTCCTCAACATGAGCAGATTGGTAAGGCATATATATTCAGCATTGATGAAAAAGAACTA<br>AATATCTTACATGAAATGAAAGGTAAAAAGCTTGGATCGTACTTTGGAGCTTCTGTCTGTGCTGTGGACCTCAATGCAGATGGCTT<br>CTCAGATCTGCTCGTGGGAGCACCCATGCAGAGCACCATCAGAGAGGAAGGAAGAGTGTTTGTGTACATCAACTCTGGCTCGGAG<br>CAGTAATGAATGCAATGGAAACAAACCTCGTTGGAAGTGACAAATATGCTGCAAGATTTGGGGAATCTATAGTTAATCTTGGCGAC<br>ATTGACAATGATGGCTTTGAAGATGTTGCTATCGGAGCTCCACAAGAAGATGACTTGCAAGGTGCTATTTATATTTACAATGGCCG<br>TGCAGATGGGATCTCGTCAACCTTCTCACAGAGAATTGAAGGACTTCAGATCAGCAAATCGTTAAGTATGTTTGGACAGTCTATAT<br>CAGGACAAATTGATGCAGATAATAATGGCTATGTAGATGTAGCAGTTGGTGCTTTTCGGTCTGATTCTGCTGTGTTGCTAAGGACA<br>AGACCTGTAGTAATTGTTGACGCTTCTTTAAGCCACCCTGAGTCAGTAAATAGAACGAAATTTGACTGTGTTGAAAATGGATGGCC<br>TTCTGTGTGCATAGATCTAACACTTTGTTTCTCATATAAGGGCAAGGAAGTTCCAGGTTACATTGTTTTGTTTTATAACATGAGTT<br>TGGATGTGAACAGAAAGGCAGAGTCTCCACCAAGATTCTATTTCTCTTCTAATGGAACTTCTGACGTGATTACAGGAAGCATACAG<br>GTGTCCAGCAGAGAAGCTAACCTGTAGAACACATCAAGCATTTATGCGGAAAGATGTGCGGGACATCCTCACCCCAATTCAGATTGA<br>AGCTGCTTACCACCTTGGTCCTCATGTCATCAGTAAACGAAGTACAGAGGAATTCCCACCCACTTCAGCCAATTCTTCAGCAGAAGA<br>AAGAAAAAGACATAATGAAAAAAACAATAAACTTTGCAAGGTTTTGTGCCCATGAAAATTGTTCTGCTGATTTACAGGTTTCTGCA<br>AAGATTGGGTTTTTGAAGCCCCATGAAAATAAAACATATCTTGCTGTTGGGAGTATGAAGACATTGATGTTGAATGTGTCCTTGTT<br>TAATGCTGGAGATGATGCATATGAAACGACTCTACATGTCAAACTACCCGTGGGTCTTTATTTCATTAAGATTTTAGAGCTGGAAG<br>AGAAGCAAATAAACTGTGAAGTCACAGATAACTCTGGCGTGGTACAACTTGACTGCAGTATTGGCTATATATATGTAGATCATCTC<br>TCAAGGATAGATATTAGCTTTCTCCTGGATGTGAGCTCACTCAGCAGAGCGGAAGAGGACCTCAGTATCACAGTGCATGCTACCTG<br>TGAAAATGAAGAGGAAATGGACAATCTAAAGCACGACTGTAGCACTTTAAAATATGAGGTTAAGCTGACTGTTC<br>ATGGGTTTGTAAACCCAACTTCATTTGTGTATGGATCAAATGATGAAAATGAGCCTGAAACGTGCATGGTGGAGAAAATGAACTTA<br>ACTTTCCATGTTATCAACACTGGCAATAGTATGGCTCCCAATGTTAGTGTGGAAATAATGGTACCAAATTCTTTTAGCCCCCAAAC<br>TGATAAGCTGTTCAACATTTTGGATGTCCAGACTACTACTGGAGAATGCCACTTTGAAAATTATCAAAGAGTGTGTGCATTAGAGC<br>AGCAAAAGAGTGCAATGCAGACCTTGAAAGGCATAGTCCGGTTCTTGTCCAAGACTGATAAGAGGCTATTGTACTGCATAAAAGCT<br>GATCCACATTGTTTAAATTTCTTGTGTAATTTTGGGAAAATGGAAAGTGGAAAAGAAGCCAGTGTTCATATCCAACTGGAAGGCCG<br>GCCATCCATTTTAGAAATGGATGAGACTTCAGCACTCAAGTTTGAAATAAGAGCAACAGGTTTTCCAGAGCCAAATCCAAGAGTAA<br>TTGAACTAAACAAGGATGAGAATGTTGCGCATGTTCTACTGGAAGGACTACATCATCAAAGACCCAAACGTTATTTCACCCATAGTG<br>ATTATTTCAAGTAGCTTGCTACTTGGACTTATTGTACTTCTGTTGATCTCATATGTTATGTGGAAGGCTGGCTTCTTTAAAAGACA<br>ATACAAATCTATCCTACAAGAAGAAACAGAAGAGACAGTTGGAGTTATATCAACAGTAAAAGCAATGATGATTAAGGACTTCTTT<br>CAAATTGAGAGAATGGAAAACAGACTCAGGTTGTAGTAAAGAAATTTAAAAGACACTGTTTACAAGAAAAAATGAATTTTGTTTGG<br>ACTTCTTTTACTCATGATCTTGTGACATATTATGTCTTCATGCAAGGGGAAAATCTCAGCAATGATTACTCTTTGAGATAGAAGAA<br>CTGCAAAGGTAATAATACAGCCAAAGATAATCTCTCAGCTTTTAAATGGGTAGAGAAACACTAAAGCATTCAATTTATTCAAGAAA<br>AGTAAGCCCTTGAAGATATCTTGAAATGAAAGTATAACTGAGTTAAATTATACTGGAGAAGTCTTAGACTTGAAATACTACTTACC<br>ATATGTGCTTGCCTCAGTAAAATGAACCCCACTGGGTGGGCAGAGGTTCATTTCAAATACATCTTTGATACTTGTTCAAAATATGT<br>TCTTTAAAAATATAATTTTTTAGAGAGCTGTTCCCAAATTTTCTAACGAGTGGACCATTATCACTTTAAAGCCCTTTATTTATAAT<br>ACATTTCCTACGGGCTGTGTTCCAACAACCATTTTTTTTCAGCAGACTATGAATATTATAGTATTATAGGCCAAACTGGCAAACTT<br>CAGACTGAACATGTACACTGGTTTGAGCTTAGTGAAATTACTTCTGGATGAATTATTTTTTATAATTATGGATTTCACCATCTTTC<br>TTTCTGTATATATACATGTGTTTTTATGTAGGTATATATTTACCATTCTTCCTATCTATTCTTCCTATAACACACCTTTATCAAGC<br>ATACCCAGGAGTAATCTTCAAATCTTTTGTTATATTCTGAAACAAAAGATTGTGAGTGTTGCACTTTTACCTGATACACGCTGATTT<br>AGAAAATACAGAAACCATACCTCACTAATAACTTTAAAATCAAAGCTGTGCAAAGACTAGGGGGCCTATACTTCATATGTATTATG<br>TACTATGTAAAATATTGACTATCACACAACTATTTCCTTGAGTGTATTCTTTGTTACCCTTTACAAGTATAAGTGTTACCTTACA<br>TGGAAACGAAGAAACAAAATTCATAAATTTAAATTCATAAATTTAGCTGAAAGATACTGATTCAATTTGTATACAGTGAATATAAA<br>TGAGACGACAGCAAAATTTTCATGAAATGTAAAATATTTTATAGTTTGTTCATACTATATGAGGTTCTATTTTAAATGACTTTCT<br>GGATTTTAAAAAATTTCTTTAAATACAATCATTTTTGTAATATTTATTTTATGCTTATGATCTAGATAATTGCAGAATATCATTTT<br>ATCTGACTCTGCCTTCATAAGAGAGCTGTGGCCGAATTTTGAACATCTGTTATAGGGAGTGATCAAATTAGAAGGCAATGTGGAAA<br>AACAATTCTGGGAAAGATTTCTTTATATGAAGTCCCTGCCACTAGCCAGCCATCCTAATTGATGAAAGTTATCTGTTCACAGGCCT<br>GCAGTGATGGTGAGGAATGTTCTGAGATTTGCGAAGGCATTTGAGTAGTGAAATGTAAGCACAAAACCTCCTGAACCCAGAGTGTG<br>TATACACAGGAATAAACTTTATGACATTTATGTATTTTAAAAAACTTTGTATCGTTATAAAAAGGCTAGTCATTCTTTCAGGAGA<br>ACATCTAGGATCATAGATGAAAATCAAGCCCCGATTTAGAACTGTCTTCTCCAGGATGGTCTCTAAGGAAATTTACATTTGGTTC<br>TTTCCTACTCAGAACTACTCAGAAACAACTATATATTTCAGGTTATCTGAGCACAGTGAAAGCAGAGTACTATGGTTGTCCAACAC<br>AGGCCTCTCAGATACAAGGGGAACACAATTACATATTGGGCTAGATTTTGCCCAGTTCAAAATAGTATTTGTTATCAACTTACTTT<br>GTTACTTGTATCATGAATTTTAAAACCCTACCACTTTAAGAAGACAGGGATGGGTTATTCTTTTTGGCAGGTAGGCTATATAACT<br>ATGTGATTTTGAAATTTAACTGCTCTGGATTAGGGAGCAGTGAATCAAGGCAGACTTATGAAATCTGTATTATATTTGTAACAGAA<br>TATAGGAAATTTAACATAATTGATGAGCTCAAATCCTGAAAAATGAAAGAATCCAAATTATTTCAGAATTATCTAGGTTAAATATT<br>GATGTATTATGATGGTTGCAAAGTTTTTTTGTGTGTCCAATAAACACATTGTAAAAAAAA |
| 122 | GGAGTTGGGAGTGTCTTCAGCCCTAAGGCAGCATCAGAGATCATAATCTTCTGCTCTCGTGGCAAGAAATTTGTGCGGATAGAGTT<br>GATACACCTCACTTGAAGTTGGCCTGGAGAAAGAGGCGTCGGACTCCTGGACGGGGTTGGGAAACGGTCACCAGTTTCGGCTCAA<br>AGCAGCCTGTTTCCAGGAGACCGCCATGGTCGAGGCAGCGTCCTGGTCCCACGGTGCGGGGCCGGACGATCATTTATGGGATATAA<br>ATAAAAGGACTATGAGGTGGTAAATAAAAGACTACCAACTAGAAGCCATAGGGAGTCATTTGAAGGAGAAATAGGCACGGCTCATC<br>TGTGGTTGAGGGAAAGGGATCTTGAAAGATGATTAGGAGAACTTGGGTTCTGGGGAAAGTGCGGGAAGACATTCTGGCAGAGAAGC<br>AAACGTGAGGAAAGGTAAGAAGGCAAGAATCTCCCATTACAAAGGGTTTGTGAAACCCTTTGCCTGTCCTTTTCGCTCCCTTCGG<br>GAGCAGTCGGCAATAAGCTGGAAGGGTAATGGGGTGAAAATGCCCGTGTCAGTTCCCTGGCTCTGCGACTCACTAGATGTCTGAC<br>AATAAACAAGTTACTTAGCTTCTGGGAGTCTGTTTTCCCGATTGTGAAATGGGGATACTATATTTGTTCTAGAGATATAAAATATT<br>AGGGTTTGCTTGCGACCGTTAATATCAAGATGTGTTCAGATGTACGAAGGGAATGGATATCTGTTGGGTACACTTGATGTGAGTGA<br>TTTTTTTTTTTTTGAGACGGGATCTTGCCGTGTTGCCCAAGCTGGTCTGGAACTCCTGGGCTCAAGCAATCCTCCCACCACAGCC<br>TCCCCAAGTGCTGGGATTACAGGCATGAGCCACCACACCAAGACGATGTGAGTGATTCACTTGATGTGAATGTTGTATTTCATTGA |

TABLE 1-continued

Sequences Table. First column: SEQ ID No. Second column: corresponding mRNA sequence. For the 3 different groups, see explanation in the text.

```
ATGGCCTGCTCTTCAGACTCATATCTCGTCATGACCTTTACAACTTCTACTACTTCCTGTGTCCCTCAGGAACCTAGCTTTTTTTT
TTTTTTTTTTTTTTTTTTGAGACGTAGTCTAGCTCTGTGACCCAGGATGAACCTCACTGCAATCTCCACCTCCTGGGTTAAAGC
GATTCTTTTGCCTCAGCCTCCCAAGTAGCATGAGCCACCACGCCCGGTTAATTTTTGAATTTTTAGTAGAGATGGGGTTTCACTGT
GTTGGCCAAGCTGGTCTCAAACTCCTGACCTCAAGTGATCCGCCCTCTCTCAGCCTCCCAAAGTACAGGGATTACAGGCGTAAGCC
ACCGTGCCCGGCCTTGCTAACTACTTTTTGTCTTTCAGTCTTTCTGGTTATACGTTGAAAGTTACTTTGAGGAAACATTTGATCTT
GCAGACTGGGCAGCCTTCTGGTTGCATCCTCTTAGAACAGGGGTCCCCAACCCTTGTACTGGTCTGCAGCCTGTTAGGAACCGGGC
GGCACAGCAGTAGGTGATCGGTGGGCCAGTGAGCAGTACCGCCTGAGCTCCTGTCAGATCAGCTGTGATATTAGCTTCTCACAGCT
CAAACCCTATTGTGAACTGGGAATGTGAAGGATCTAGGTTGCTCACTCCTTAAGAGAATCTAATGGGAAATGTAATGAGCTTGAAT
CATACTGAAACCAGCTGTCCAACTCCTGTGGAAAGATTGTCTTCCCTGAAACCGGTCCCTGGTGCCAAAAAGGTTGGGAGACTCCC
TATAGGACTCCACTTCTGAGCACTGATAATTAAGGGTTATCTCACTCTGTATGGACTATAGTTCTGAGGCCAAGGAACCGTATTTA
CCTTGCTCACTGCAGTATCCCTAGGATCTAGCATACTGCCTGGCACATAGTTGGCATTTTTGTTTCACATTCCTTGCCTAATCTT
GAGTTCCTTGAGGGCAGAAACTGCCCAGCTCCTGATATGGCATATGGTGCCCTGCCATATTTTGTCTGGTCCTTCCAGTATATAC
AATGCAAAGAGCATGAAAGGTGGCTTGAACTCTAGGTGCTGGAGGGTGTAATTCTTGTGAATTAGTAAAAATCATGAGAAGAGCTT
TAGACTTTTACTGACTAGAATTGTCACAGGTTTCAAGCCAGTTATGTTTAGATTTTCAGGGGGTGGGGGCTCCAGATGACATGGTAT
ACCCAAAATGTTGTGTGAGAAATTGGGTATACCCAAAATTTTGTTGTATTTTGTTATTCTGAGAAATGTAGATTCCACTGTATT
CTCCAAAGGTGTTTATATCCACCATCCCCTCCCAAAAGTTAAGAGCCACTGTCCTAGTAGTACTTTTTAGAACATTGACTTTATAT
AAGAATTGGCAATTTTCGTTTCTATATCATTCTAATCCTATATACTTTGTAGCTTTTAGAAATGCTCAGAATTCTGCTGCTGTGGA
CTTGTTTCTATTTCTTATGTCATTTTAATGGAGTTTTGTGGCAAACAGCCTATAAATATGGGGCTTAACCTGCCATTTTTGAAACA
GGAATCTTCCAAACCATAGTGGTGTTTGTTTTTTTTTTTTAAATAACAAATTTACATCTCACATTGTGAAGGATGGAAAGATTG
TCTGGTGAGGGGCCACTCTGATTCATAGATGGCATCTTCTGTTTTCACATGGTGGGAAAAAAACCAGACTGATCTCTTAAAGCATG
TATCTGATGCCACTTTCCTACCCTCACGATAAAATCCGAACTCCAAAGAAGAGCAGTAAGAGCTTTTGTGATCTGGCCTCTGCTTG
CCACCTCCCCAACTCACATAGGTCTCTATACTTATTTCCTAGCCCCCTTGCATGCTATTCACCTCTAACTTCCATGTAGTTATGTG
TCCCCCTACCTCCTGGAATTTGCATTTTTATTCATCTGACAAGTGTTTGTCTTGTATATGCCAGTGCCGTGTATTACACCAGTTGC
TGTGATACAGCTGACAACAAAGAAGACAGCCCAGTGTAATACATTTATTTTCTAGTTGGGAGAGATGGGTAATAAATAAACATGTA
CTATGTTTGGTGGTAATAAGTTTGCTGAAGAAAATTATGGAAAGGTAAGAGAGTTGAGTATAGACTGTGGAGAATTAGTCTTTTT
CATTCACAGTATACAATTGTTTTCTAGAGATCAGAGTCCTTCCTACTTTTGTGTATTCACAATACCCTATTGTTAATTCCATATTA
AGACTATATACGGTGTTTTGAAATTGTCTGCCTCTGGAGACTTCCAAGATTCATTGAGAGCAGAAGGTTAATTTTGTTCATCTTTG
CATTCCCAGGGTCTTATATATACATAATAGGCTGTATTTGTTCTCTAAAAAATACAGAACCAATAGGATATGTACAGATTATGAGA
AATTGGCTCTGCAAAATGGAGGTGAAGTCCCACAGTCTGCCTTCTGCAGGCTGAAGGCCCAGGAAAGCCAGTGTAGTTCCAAACCC
GAGGGCTTGAGAATCAGGGGAGGCAATAACGTTAAGTCCTAGTCTGAAGGCCTGAGGACCAGGAGCACCAACATCTGGGGGCACGA
AATGGATGTCCCAGCAGTTCACCCTTCTTCCCCTTTTTGTTCTATTCAGGCCCTCAATGGATTAGATGACGCTCACCCACATGGG
TGAAGGCAGTCTTCTTTACTCAAGTCTACTGATTCAAGTGCTAGTCTCTTCCAGAAACACCATCACAGATGTACCTAGAAATGTTG
TTTGACCAGCTATCAAGGCATCCCGTAGCCTAGTCAAGTTGACAGAATTAGCCATCTCATCAGTATCCACAATGTATTTTTATATT
AATGGATTTAGCCTGAGAAGCTTCCATGTACAGTATCTTTTTTTTTTTTTGGCGACAGAGTTTTCGCTCTTGTTGCCCAGGCTGG
AGTGCAATGGTTCGATCTCGGCTCACCACAACCTCTGCCTTCCGGGTTCAAGCGATTCTCCTGCCTCAGCCTCCCGAGTAGTTGGA
ATTATGGGCATGCACCACCATGCCTGGCTAATTTTGTATTTTTAGTAAAGAGGGGGTTTCTCCATGTCAGTCAGGCTGGTCTTGAA
CTCCCGACCTCAGGTGATCTGCCCACCTCACCCTCCCAAAGTGCTGGGATTACAGGCGTGAGCCACTGCACCCAGCCTCATGTACA
GTATCTTATGGTATCTTGTCAACTCAGAGGCAAGCAGAAGAAATAAGACGTGAGCCACCGCGCCCAGCCTCATGTACAGTATCTTA
TGGTATCTTATCAACTCAGAGGCAAGCAGAAGAAATATTTAGCTCCATTTTATAACTTGATTTCCATTCCACTATTTTCATTGTAC
TGCAATGTGAGATTAACAATTCCACCCCAAGTATTTGAGGTGTGGGAAGCTGGATGTAAAAACACCATTAAAAACAACTCTTTTCA
ATGGCTTTCTAAGGTTGGCTGGGCTGAAATGGCAGGTTGTGGATGCTCCGTGGCACATCACACTGCCCCTTTCTTCATATTAGAAA
TTAAATCAGCCGATGGCAATATTGAATTCCAGGTAATTTTCCTTCTTTCTTTTTTTTTGAAACAGAGTTTTTGCTCTTGTTGCCCAG
GCTGGAGTACAATGGCGCAACCTCGGCTCACCACAACCTCCGCTTCCCAGGTTCAAGCGATTTTCTCTGCCTCAGCCTCCTGAGTC
GCTGGGATTACAGGAATGTGCCACCATGCCCGGCTAGTTTTGTATTTTTATTAGAGACTGGGTTTCTCCATGTTGGTCAGGCTGGT
CTCGAACTCCTGATCTCAGGTGATCCACCTGCCTCGGCACCCAAAGTGCTGGGATTACAGGCATGAGCTACCATGCCCAGAGAAT
TCCAGGTAATTCTCATGGTGAATGAATTCCATTCATACTGTTCTTCAGTCTGCCAAATGGATATTACATAACACATTTGTGTG
CCATGATGGGCCTTACATATATTGACTCATGTAATTCTCACAACTTTATGAGGTGGTATTAGTCACATTTTCATTTCATGAAATTG
AGGCACAAAAAATTAGACATGTTGAAGATCATACATCATCCCTCACCTGGGCTACAATAGCCTCTTAACTAATCTCTGCTTCTCC
TCTTGTCCACACAACAGCCAGAGAACCTTTAAATATGTTAAGTATGTCAAGCCTCTGCTCAAACTGAGTTTTTCCTGTCACACTTC
AGTGTGGCCTATAGGCCCTAAGTGATGTAGCCTTTGCTTATATTGTCTTCCACTCTCATCCTTGTTCACAGAGCTCTAGCAATTCT
CATGTTTGGAGGTCCTCAAGGCAAAACTCAGCTTTATTTCCCATTCCCTTAGTATGGAAAGCTATTTCCCTATCTGTGTGTCTTGC
TTTTACATCATTGCTCTGCTCTCCTCAAAAACCTTCCCCTCTTATCCCATCACCGTCCTCATTTTGATTCTTCATATACATTTAT
CCTTTCCTGATTTTATACTGTTTACCTTTTATGGTTTGTTTCCCCTCTAAAACATAAGTTCCATCTGGACAAGGGCTTTGCTCA
GTCCTATTTTCCTAGGCCCTAGAATCAAACCAGTATTGGGTGAATGGATACTGAATGAAGCTTTACCTAAGTGCTTTGTCTTTTAC
TTAGTTTCAGTGGTTAAATCTCAGAAAGCTTAACAGCAATTCTAAGCATGTCTTTATCATAAAAGGTTAAAAACTGTATTATTGGG
ATATTTTTTCTCTTTTTATGTTTACCTACAAGCCCGTAGAAAGTATAAATACTCAAAAGATAGCAGACCAGGTAGGCTTAAGTTAC
TTTTACAAAACAGTAGAAATACCTTCAAATATTTAGCACTGATGAACTTACTACTGAGGACATGTGGACTCTACTAAGAAACTAAT
GATGAAATTCATAATTGGGTGGTAGCACATGCACCCAGCTACTCGAGAGGCTGCAGCTTGAGTCCAGGAGTTCAAGGCTGCAGG
GAGCCATAATCATGCCACTGCACTCCAGCCTGGGAGACAGTGAGAACTTGGCTCTTAAAAAAAAAAAGGAAAAAAAAATTGATAAC
GACAATTTGTAATGGTCAGTCCTATCCACCAGTCTAAATGAAAGTTTAAAAATTTTCATATACTGCACAGAAGTAGATGGAGTCTT
AATGCTAGGTAAGGGTAAACAAGCTGAAATAGCAGTCAGTGACTTCAGAGACCATGAAACAAAGTTAATCTTCAAGTCCTTTTA
ATTGTTCTTATAAACTAGCATAAGATATAAACTTAAGTAGTACACATGAGTTTTATAATTTACTAATCTCTGACAGATAGCTAAGC
ATAGCACATCAGACATAACGCAGTGTGAGGGAAATAAAGTGTACAATGACATCTTCTATTCTGGCACTAACAATCAATAGAGAA
AGAACTACTTGTAGTCACTGTGGTTACAGAAGGTTTCATGGACAGCGAACATAAAGCTCTACTAGCTAACAAATAGGTCTTAATGA
TAAAAACGTGGGCCTTCAGAGAACTAAAGGTACCAATGTGGCAGTCCAAAATTACGAGGAAATGAGTTCCCTTCATGGGTCAC
ATCAGCAATTTTTTTTTCCCCTTTTGAGACAGAGTCTTGCTCTGCTGCCCAGGTTGGAGTGCAGTGGCATGATCTAGGCTCACTG
CAACCTCCGCCTCCCGGGTTCAAGCAATTCTCATGCCTCAGCCTCCCGAGTAGCTGGGATTACAGGTGCCTGTCATCACGGCTGGC
TACTTTTTGTATTTTTAGTAGAGACAGGGTTTCACCATGTTGGCCAGGCTGGTCTCAAACTCCTGACCTCAAGTGATCTGCTTGCT
TCAGCCTCCCGAAGTGCTGTGATCGTAGGTGTGAGCCACTGTGCCCAGCTACCTCATCAATTCTTAATCTATAAACCATGGATAGG
CTTCGGGAGAACCCAAGAACCAATGAAATCTGTTGGTAAGTTTTATGTGTGCGGTTTTCTACAGAGAGGGTCAACAGCATGTATAT
TTTCAAAGAAGTCTGTGGTGCAAAAGAGTTTATTGTTAGAAATGCTTGGGCAATCAACTTGGAAAAGGTGGATTGAGAATGGG
GGCTGTCTAGATCAGGATAATGTTGAATTTGACCCTCACTTGAGGCTTTTGTACAGAGGATGAGAAGACGGTAAATTCAAGGGTTA
ATCAGAAATTAACACCAACATGACTTGGTGATGAGTGAGATGTGAAACGTGAGAAAAACATCAATGATGAAATCAAGCTTCTGACT
TGCAACAGTGAGTATACCAAGAGCTACAGGCTTGGAAGATGAATAAAGTTGGGAGCATTCTGTTTTTTCATGAGTGCCCATGGGAC
AGACAGGGAGAAATGGACAGTTGAAAGTACAAGTCTAGACAGGCACAGTGGCTCATGTCTGTAGCCCTAGCACTTTGGGAGGCTGA
GATGGGAGAATTACTGGGGTTCGGGAGTTTGAGACGAACCTGGGTGACATAGTGAGAGCTCATCTCTGCAAGAAGTAAAATTAGCT
```

TABLE 1-continued

Sequences Table. First column: SEQ ID No. Second column: corresponding mRNA sequence. For the 3 different groups, see explanation in the text.

CGGCATGGTGCTGCAAGATTATAGTCCCTGTTAGTCGAGAGGCTGAGGTGGGAGAACTGCTTGAGCCCGGGAGGGAAAGCAGCAGT
GAGCTGAGATCACGCCACTGCACTCCAGCCTGGGCGACAGTGAGACCCTGTCTCAAAAAAAAAAAAAAAAAATGCAAGTCTGGAGA
AATATAGCTGGGAGTCAGTAATGCCAGTTTTAGCTGAGGGAGTTAAGATCATTTAATCAGTGTTAAGGAAGAAACTCAATAGTAGT
GACCACCAATACTTAAGGAAAAAGGATAAAGTAAGAGGAATGATAAAGGCTGGCTGAAATATCTTGGCGTCTAGCCTAAGAAAGGA
GGGGTTAGATGCTCATGTTTATTAATATGGATCTAGAGAAGCATTTATTCACTAATACATTTTATTTGTGTTCTCTAATTTAAAAT
TACCTTTTCATCTTGCTTGATTTTCCTTCAGCTAAATTAGAAATTTGTAGTTTTTCCCCTAAAAAATTCAATGGCATTCTTTCTTA
TAAATTACATTCTCTGATTTTCTTGTCAGCCTGCTTCAAGGAAATCCATGTGTTCAAAATGCTTGCTCGCAGTTTGCTCCATACCA
AATGGTTGCTTAACCCAAATATCTGAGCAGCAAATTGAGCTGATCCTTCTGGAGAAAGTACGGTTGAACAGCCAAGACCTATTGGT
TCAGCAAGGAAAAGACAGAAAATTGAGCTCAATTAGTAATGAAAATACAACCTTACAAAAAATTTTATACTCAGAGCAGTCCTGCC
ACAGAAAATAAAAAGCTACTGCATTATTCTAATCTAAAGTAGAATCTGTACAACTGTCTTTAATACCGGAGTGGTAAGGTGATTAC
AAGAGGAAAAGCAGTCAGTATTACCTGCCATGAAGAGATATTTTATATATATCATCTATCACCCTTCTTATAGAACTCACTTACAA
AGAAACTTATCTTTTTGAAACTTCTGTTCACATACACTATCCCTTTCAATCCCTGGCGAAGAACAACTGAAGCAAAATAAGGGTCA
AGGTAAGAGTACAAAAGTACCTGTTCTTAGACAAACTTGAGCTATGTTGTTTTGACAGTTTTCTAGCTAATCTTTCTATCTGCATT
TGAACTATTTTAATATTTTTGAGCAGTAAAAGTCAAATCCGTAGAATAATTTTAGGAAATGTCAAGTTACAAATAAATATTAATAA
GATCCAAGACAGCAGAATAAAAAGTAACATCCTAGGGGCCACATGTCTGCTCAGGCAGAGTGTCTTGAGGTGGTACTATTATGTC
TAGTGTTTGCTAGAATCAGGGGTACTATTATGTCTAGTGTTTGCTATAGTTCCAAAAGCTCGATTTTCCCGATATTCTTGGAATTC
ATCAGGCTCTTTGACTCCCATTATCCACAAGAACAGAGTCAAATACAAATCACAAGGCCAATTTACTAATTTGTATTAATACGTTA
TTTTATGGAGCTCCACCCCTTAATATGTGGTATTGGTCAAGTTACTTCACGTTAATTTATTCTCCTCTTCTGTGAGAAGGGAATTT
TAACTAGTAGCTACCTGATGTGACACTTCAATGAGTTAATAACATAGATAAAGTGCTTAGAGCATTGCCTGGTACACAGTATGTGC
TCCAAGAATGTCAACCACTATTGTTAGCACGCTAGGTAGAGTGCTCCACTCTAATATTTGAAATAACCTGTGCCTCCTGCCCAGGA
CTCCCTTTCTGGTAAAAGAATAGCTTAAATTGCAGAAAAAAAAAAAAAAGTTATCTAGTGACGTGACATCAGAGATGAGAAATAT
GGGCGGTCTTCAGGATTTTACACAGGTTACTGTAAAACTACTCCTCAAAAGATTATCCCCAATTCTAGTGATCATTATGTACAAGT
CCTCCAGATTATTTGTCACTCCTGAAACAACACTACTATAAAAACTGCCAATTTTTGCTTATCATGCTCCCCTTTTGTAAGCTCC
ATGGGTATCTATACAATTCCTCTGGCATAAATTTGGTTACAGCTTTATTTGTAGCCGCTGATTTTTAGCTTGAGACATTTGTATAA
TCACATCTTGTTAAAGATAGCTTAGGCACAAAATTTAATTCTCAAGACCCTATAAAAACAGTAAAGGAAATAGGCATGAACACACAA
GGCCAGATAACAGCAGTAACATTTTGGCAACTGAAAGGCAAACACAGTGGTAGCTAAGTTAGCAGACCAAGAAAACTTAATCAAAA
TTAGCTGGCATGGTGGTGCATGCCTGTGATTTCAGCTACTTGGGAGGCTGAGGCGGGAGAATCGCTTGAACCTGGGAGGCGGAGGT
TGCGCCATTGCATTCTAGCCTGGGCAACAGGAGCGAAACTCCATTTAAAAAAAAAAAAAAAAAA

123 GGACCAATAGAATATGTGATGTGTGAATTTTCTTTAAAAAACTTAAGGAGTCTTGGCTACCTTCTGCTTGTGAGTTGTTTGGGCAT
TCATATTAAAAGCCAGCATCTCACTATTTATTGGACAGGTGGGCTGTGTGTGTGCGCATGTGTGTATACATTTCCAGGCGTGCCTG
TGTCCTGTAGCTTTTTAAAAGGAAACCCAGTCATCCCACTATGAATCTGGCATCTTCTTATGCTTCTAGTGTTTTGGCCATACATC
AACCAAGGGGTTTAATTTATCCAATGCTTGACGACATGTTCAGGAGGGGCTGGATCAAATTTTGAGAGGGTTATGGGAAAGGGAGG
GGGAGAAGAAATTGACATTTATTTATTTTAAATGTTTACATCTTCTTTATGTTGTATCAAGCCTGAATAGAAACTGATA
GCATTAAAATACTCCCGTTCCTCTCTCTCTTCTCGCTTCGCTTTTTTTTTTCTCAAATTTAGGATACCCAATTTGTGTTCCCACAGCG
CTCGGGACTGGCGGGTATACCTGGTTAAAGGTCCGGATAAACAGGGATCACATCCTCTGGACAGGGTCGCACAAATCTCTTGTCGG
CAACCCGGGAACTCGCGCTTCCAAAAATTTCCCGTGTTGAAGGTCCCCATAGCGGGTCCTCCTGGAGAACAATCTGGTATAGCCGG
GCAAAGAAGGTCTAGTCTTTCCCCTTATCATCTTGTTTTACATTCCGCTCACTACTTTTTTTTTCACACAACACACCAACAACACCC
ACCCACCCCCCACCAACCCCACACCCACCCCCACCCAGGCGCTGAAGAGGAGGCGAGAGCCGCCGCACACGCGGACGAGCGCGGGCG
AGGCGAGGGCGGGAGCGGGGAGGGGGACGAGGGACGGGGGACGCGGGGGGGAGAGAGGCGGGGAAGGGGGAGGCGAGGAGGAGA
GCGCTACAGCGCCACGACGAGCGAGGACAGCAAAGGAGAGGAAACGCGAGGCGGGGCGAGACAGGAGAGAAAGGACACAAAAGGGA
GCGCGACAGGGAGAGAAACGGCAGCGACAAAGAAGACAGAGAAGACGACACAGAGGAGAGACAGGCGGAGAGAGAAGAAACGTA
AGCAGAGAATAGAGGAAGAAGGAACCAGAGCACAAGGGGACGCGACAACAGAGGCGCAGAGAACCAAGACAGAGAGAGA
CAGGAACGAGAGGCAAGAGCAAACAACCAGAAGCAAAAAGAGACCACGCGAGAGCACGAGAGGAAGCGAGAGCACACAGCAGGAAG
CCGAGCCCAAAGCAGAGGCAGAGACGCAGAAGGCAACGAAAGGCACGCAAGCCCGAAGCAGCGCACCACAGACACGAAAACCCA
GCAAGCACGAACACCACCAAACACAGCACCAGCAAGCGACGAAGCCGACACAGAAACCACAAGACAAACACCAGCGACACACCGCA
ACAGCACCACGACGCGAAGACCAAGAGAGACAACAGACGCAGCAAACAGCCGAAGCACCAGACAACA

124 GGACCACAGCTCCTCCCGTGCATCCACTCGGCCTGGGAGGTTCTGGATTTTGGCTGTCGAGGGAGTTTGCCTGCCTCTCCAGAGAA
AGATGGTCATGAGGCCCCTGTGGAGTCTGCTTCTCTGGGAAGCCCTACTTCCCATTACAGTTACTGGTGCCCAAGTGCTGAGCAAA
GTCGGGGGCTCGGTGCTGCTGGTGGCAGCGCGTCCCCCTGGCTTCCAAGTCCGTGAGGCTATCTGGCGATCTCTCTGGCCTTCAGA
AGAGCTCCTGGCCACGTTTTTCCGAGGGTCCCTGGAGACTCTGTACCATTCCCGCTTCCTGGGCCGAGCCCAGCTACACAGCAACC
TCAGCCTGGAGCTCGGGCCGCTGGAGTCTGGAGACAGCGGCAACTTCTCCGTGTTGATGGTGGACACAAGGGGCCAGCCCTGGACC
CAGACCCTCCAGCTCAAGGTGTACGATGCAGTGCCCAGGCCCGTGGTACAAGTGTTCATTGCTGTAGAAAGGGATGCTCAGCCCTC
CAAGACCTGCCAGGTTTTCTTGTCCTGTTGGGCCCCAACATCAGCGAAATAACCTATAGCTGGCGACGGGAGACAACCATGGACT
TTGGTATGGAACCACACAGCCTCTTCACAGACGGACAGGTGCTGAGCATTTCCCTGGGACCAGGAGACAGAGATGTGGCCTATTCC
TGCATTGTCTCCAACCCTGTCAGCTGGGACTTGGCCACAGTCACGCCCTGGGATAGCTGTCATCATGAGGCAGCACCAGGGAAGGC
CTCCTACAAAGATGTGCTGCTGGTGGTGGTGCCTGTCTCGCTGCTCCTGATGCTGGTTACTCTCTTCTCTGCCTGGCACTGGTGCC
CCTGCTCAGGGAAAAAGAAAAAGGATGTCCATGCTGACAGTGGGTCCAGAGACAGAGAACCCCCTTGTGCAGGATCTGCCATAA
AGGACAATATGAACTGATGCCTGGACTATCAGTAACCCCACTGACCAGGCACACGATGCTCTGGGACATAACTGGTGCCTGGAAAT
CACCATGGTCCTCATATCTCCCATGGGAATCCTGTCCTGCCTCGAAGGAGCAGCCTGGGCAGCCATCACACCACGAGGACAGGAAG
CACCAGCACGTTTCACACCTCCCCCTTCCCTCTCCCATCTTCTCATATCCTGGCTCTTCTCTGGGCAAGATGAGCCAAGCAGAACA
TTCCATCCAGGACACTGGAAGTTCTCCAGGATCCAGATCCATGGGGACATTAATAGTCCAAGGCATTCCTCCTCCCCACCCACTATTC
ATAAAGTATTAACCAACTGGCACCAAGGAATTGCCTCCAGCCTGAGTCCTAGGCTCTAAAAGATATTACATATTTGAACTAATAGA
GGAACTCTGAGTCACCCATGCCAGCATCAGCTTCAGCCCCAGACCCTGCAGTTTGAGATCTGATGCTTCCTGAGGGCCAAGGCATT
GCTGTAAGAAAAGGTCTAGAAATAGGTGAAAGTGAGAGGTGGGGGACAGGGGTTTCTCTTTCTGGCCTAAGGACTTTCAGGTAATC
AGAGTTCATGGGCCTCAAAGGTAAATTGCAGTTGTAGACACCAGGATGGTTGACAACCCATGGTTGAGATGGGCACCGTTTTGC
AGGAAACACCATATTAATAGACATCCTCACCATCTCCATCCGCTCTCACGCCTCCTGCAGGATCTGGGAGTGAGGGTGGAGAGTCT
TTCCTCACGCTCCAGCACAGTGGCCAGGAAAGAAATACTGAATTTGCCCCAGCCAACAGGACGTTCTTGCACAACTTCAAGAAAA
GCAGCTCAGCTCAGGATGAGTCTTCCTGCCTGAAACTGAGAGAGTGAAGAACCATAAAACGCTATGCAGAAGGAACATTATGGAGA
GGAGGGTACTGAGGCACTCTAGAATCTGCCACATTCATTTTCAAATGCAAATGCAAATAGCATCAGCAGTTTACCTTAGTTCAAGGGGAGGAGG
CAAAGACCCCACAGCCCAACAGCAGGACTGTAGAGGTCACTCTGACTCCATCAAACTTTTTATTGTGGCCATCTTAGGAAAATACA
TTCTGCCCCTGAATGATTCTGTCTAGAAAAAGCTCTGGAGTATTGATCACTACTGGAAAAACACTTAAGGAGCTAAACTTACCTTCG
GGGATTATTAGCTGATAAGGTTCACAGTTTCTCTCACCCAGGTGTAACTGGATTTTTTCTGGGGCCTCAATCCAGTCTTGATAACA
GCGAGGAAAGAGGTATTGAAGAAACAGGGGTGGGTTTGAAGTACTATTTTCCCAGGGTGGCTTCAATCTCCCCACCTAGGATGTC
AGCCCTGTCCAAGGACCTTCCCTCTTCTCCCCCAGTTCCCTGGGCAATCACTTCACCTTGGACAAAGGATCAGCACAGCTGGCCTC

TABLE 1-continued

Sequences Table. First column: SEQ ID No. Second
column: corresponding mRNA sequence. For the 3 different
groups, see explanation in the text.

```
     CAGATCCACATCACCACTCTTCCACTCGATTGTTCCCAGATCCTCCCTGCCTGGCCTGCTCAGAGGTTCCCTGTTGGTAACCTGGC
     TTTATCAAATTCTCATCCCTTTCCCACACCCACTTCTCTCCTATCACCTTCCCCCAAGATTACCTGAACAGGGTCCATGGCCACTC
     AACCTGTCAGCTTGCACCATCCCCACCTGCCACCTACAGTCAGGCCACATGCCTGGTCACTGAATCATGCAAAACTGGCCTCAGTC
     CCTAAAAATGATGTGGAAAGGAAAGCCCAGGATCTGACAATGAGCCCTGGTGGATTTGTGGGGAAAAAATACACAGCACTCCCCAC
     CTTTCTTTCGTTCATCTCCAGGGCCCCACCTCAGATCAAAGCAGCTCTGGATGAGATGGGACCTGCAGCTCTCCCTCCACAAGGTG
     ACTCTTAGCAACCTCATTTCGACAGTGGTTTGTAGCGTGGTGCACCAGGGCCTTGTTGAACAGATCCACACTGCTCTAATAAAGTT
     CCCATCCTTAATGACTCACTTGTCAACTAGTGGACTAATTAACCCTCCACCAAAAAAACACAAAGTGCTTCTGTGAGACCAATTTT
     GTGCTAATGAGCATTGAGACTGATGCTTTGTAAGTCACACCACAACAAATATTGATTGAGGGCGCTGCATGTGCTGGGTACATTTC
     TTGGCACTTGGGAATCAGTAGTCAAGCGAAACCCTTGCCTTTGAGAGTTTATGGTCTGGATAATATAAATAAACAAGTAAGCATAA
     AAAAAAAAAAAAAAA

125  AGCTTGATTAGGTTATTATCTGTCAAACCTTTTAAGTTGACAACATGACTCATATATATACATGTGTATAAGATGAGCATGTGTCG
     AAGNTTATTCGACTCATTAATGAGGAAACCAGCAGATAGTAAACCTGGTTCAAAGTACAATTCAAGAAACTGAGTATTTATGGGCA
     TTGAAGAAAAAATGTTGAGATAAAATTGCTGTGCAGAAAAAAGTGTTAATGAAGCCGACCTGACTACTTAACCTTAAGAGACCTGC
     TTTACAAAGGTTGGCCCTTGATTGGCATCTGGGAACTTGGAGTTCAGGGGGCTTCCACCATTCCCAGAACTGATCAAAGTAAGCTT
     ACTATATCTAAACTGTAAAACCATATAGGTTTCTCCTGGAACACCTGGCTTTCCCTCCGGGAGTCNGGGAATTTTGGGTAAGGTG

126  GGCAGAAGAGGAAGATTTCTGAAGAGTGCAGCTGCCTGAACCGAGCCCTGCCGAACAGCTGAGAATTGCACTGCAACCATGAGTGA
     GAACAATAAGAATTCCTTGGAGAGCAGCCTACGGCAACTAAAATGCCATTTCACCTGGAACTTGATGGAGGGAGAAAACTCCTTGG
     ATGATTTTGAAGACAAAGTATTTTACCGGACTGAGTTTCAGAATCGTGAATTCAAAGCCACAATGTGCAACCTACTGGCCTATCTA
     AAGCACCTCAAAGGGCAAAACGAGGCAGCCCTGGAATGCTTACGTAAAGCTGAAGAGTTAATCCAGCAAGAGCATGCTGACCAGGC
     AGAAATCAGAAGTCTGGTCACCTGGGGAAACTATGCCTGGGTCTACTATCACATGGGCCGACTCTCAGACGTTCAGATTTATGTAG
     ACAAGGTGAGACATGTCTGTGAGAAGTTTTCCAGTCCCTATAGAATTGAGAGTCCAGAGCTTGACTGTGAGGAAGGGTGGACACGG
     TTAAAGTGTGGAGGAAACCAAAATGAAAGAGCGAAGGTGTGCTTTGAGAAGGCTCTGGAAAAGAAGCCAAAGAACCCAGAATTCAC
     CTCTGGACTGGCAATAGCAAGCTACCGTCTGGACAACTGGCCACCATCTCAGAACGCCATTGACCCTCTGAGGCAAGCCATTCGGC
     TGAATCCTGACAACCAGTACCTTAAAGTCCTCCTGGCTCTGAAGCTTCATAAGATGCGTGAAGAAGGTGAAGAGGAAGGTGAAGGA
     GAGAAGTTAGTTGAAGAAGCCTTGGAGAAAGCCCCAGGTGTAACAGATGTACTTCGCAGTGCAGCCAAGTTTTATCGAAGAAAAGA
     TGAGCCAGACAAAGCGATTGAACTGCTTAAAAAGGCTTTAGAATACATACCAAACAATGCCTACCTGCATTGCCAAATTGGGTGCT
     GCTATAGGGCAAAAGTCTTCCAAGTAATGAATCTAAGAGCAAATGCCAAGTGTATGGGAAAAGAAAGTTACTGGAACTAATAGGACAC
     GCTGTGGCTCATCTGAAGAAAGCTGATGAGGCCAATGATAATCTCTTCCGTGTCTGTTCCATTCTTGCCAGCCTCCATGCTCTAGC
     AGATCAGTATGAAGAAGCAGAGTATTACTTCCAAAAGGAATTCAGTAAAGAGCTTACTCCTGTAGCGAAACAACTGCTCCATCTGC
     GGTATGGCAACTTTCAGCTGTACCAAATGAAGTGTGAAGACAAGGCCATCCACCACTTTATAGAGGGTGTAAAAATAAACCAGAAA
     TCAAGGGAGAAAGAAAAGATGAAAGACAAACTGCAAAAAATTGCCAAAATGCGACTTTCTAAAAATGGAGCAGATTCTGAGGCTTT
     GCATGTCTTGGCATTCCTTCAGGAGCTGAATGAAAAAATGCAACAAGCACAGATGAAGACTCTCGAGAGGGGTTTGGAGTCTGGAAGCC
     TCATCCCTTCAGCATCAAGCTGGAATGGGGAATGGAGAATAGAGATGTGGTGCCCACTAGGCTACTGCTGATAGGGAGCTGAAATT
     CCTCCACCAAGTTGGTATTCAAAATATGTAATGACTGGTATGGCAAAAGATTGGACTAAGACACTGGCCATACCACTGGACAGGGT
     TATGTTAACACCTGAATTGCTGGGTCTTGAGAGAGCCCAAGGAGTTCTGGGAGAGGGACCAGATTGGGGGGTAGGTCCACGGGCTT
     GGTGATAGAATTATTTCTCGATTGACTTCTTGAGTGCAATTTGAACTGTAACATTTGTTAGTCACCTTTAGTGGAGTAATCCACT
     GGGCTTGTTTCTATATTTATATAAAGCAGCCAAATCCTTCATGTAATATTGAAGTCCATTTTTGCAATGTTGTTCCATACTTGGAG
     TCATTTTGCATCCCATAGAGGTTAGTCCTGCATAGCCAGTAATGTGCTAAGTTCATCCAAAAGCTGGGGGACCAAAGTCTAAATAG
     GGCTCAGTATCCCCCATCGCTTATCTCTGCCTCCTTCCTCCTCCTTCCCAGTCTATCATCAACCTTGAGTATTCTACACAATGTGA
     ATTCAAGTGCCTGATTAATTGAGGTGGCAACATAGTTTGAGACGAGGGCAGAGAACAGGAAGAATACATAGCTAGAAGCGACGGGTA
     CAAAAAGCAATGTGTACAAGAAGACTTTCAGCAAGTATACAGAGAGTTCACCTCTACTCTGCCCTCCTCATAGTCATAATGTAGCA
     AGTAAAGAATGAGAATGGATTCTGTACAATACACTAGAAACCAACATAATGTATTTCTTTAAAACCTGTGTGAAAAAATAAATGTT
     CCACCAGTAGGGATAGGGGAAAAGTAACCAAAAGAGAGAAAGAGAAAGGAATGCTGGTTTATCTTTGTAGATTGTAATCGAATGGA
     GAAATTTGCAGTATTTTAGCCACTATTAGGAATTTTTTTTTTGTAAAATGAAGACTGAACTCTGTTCAAATGCTTTCATGAACC
     TGGTTTGAGACGGTAGGAAAGCAACAAAACGTGGGAACCTGGTGACTAAGGGCCTGGTGCAAGGACTTGGGAAATGTCATTAATAA
     TAGATGGTGGGGTTTTCCCCCCTTTAGAAATGTTGGATATTAAGTGATATAAACACTTCTTTTAACTCCGAAAATCTTCTGAGAAA
     TCACAAAATTCACGGTATGCTTGGAACGATTGAGATTTTCTAGGTAGATGCTGAATAGCCTAGACATCAAAGTTGGTGTGAACCAA
     AATAGAGTCAGCTGACCCAGCATCAGCCACACTCTGGGTTGGAAAATGTTTGCCTGTTGGAATTAATTTAAGCTTAAGTATATATC
     AACATTATTTTATTGTGCAATTAAAACAATACAAATTCATGGTTTTTTAAAGTTAAAAATTCTAACCACTGTAACAACAGTTTTTG
     TGTTATTTTCTGTATTAAACATCTTGTTGCACGCATTTGAGGTCATCAGGGTGCAAAATTTGTATTCCTGAAAATGTCATATATTT
     TCATTAATAAATAACCTAAATATGATAAAACATAAAAAAAAAAAAAAAA

127  GGCACAGTCATAAATACAGAGGGTTTTCAGAACCACCTCAGAGAAGATGTTTAAATCGCTGACAAAAGTCAACAAGGTGAAGCCTA
     TAGGAGAGAACAATGAGAATGAACAAAGTTCTCGTCGGAATGAAGAAGGCTCTCACCCAAGTAATCAGTCTCAGCAAACCACAGCA
     CAGGAAGAAAACAAAGGTGAAGAGAAATCTCTCAAAACCAAGTCAACTCCAGTCACGTCTGAAGAGCCACACACCAACATACAAGA
     CAAACTCTCCAAGAAAATTCCTCTGGAGATCTGACCACAAACCCTGACCCTCAAAATGCAGCAGAACCAACTGGAACAGTGCCAG
     AGCAGAAGGAAATGGACCCCGGGAAAGAAGGTCCAAACAGCCCACAAAACAAACCGCCTGCAGCTCCTGTTATAAATGAGTATGCC
     GATGCCCAGCTACAACCTGGTGAAAAGAATGCGTCAAAGAACAGCCCTCTACAAGAAAAGTTGGTAGAGGGAGATCTCTCCTC
     ACCCGAAGCCAGCCCACAAACTGCAAAGCCCACGGCTGTACCACCAGTAAAAGAAAGCGATGATAAGCCAACAGAACATTACTACA
     GGCTGTTGTGGTTCAAAGTCAAAAAGATGCCTTTAACAGAGTACTTAAAGCGAATTAAACTTCCAAACAGCATAGATTCATACACA
     GATCGACTCTATCTCCTGTGGCTCTTGCTTGTCACTCTTGCCTAACTGGAACTGCTGGTTTATACCACTGCGCCTCGTCTTCCC
     ATATCAAACCGCAGACAACATACACTACTGGCTTATTGCGGACATCATATGTGATATCATCTACCTTTATGATATGCTGATTTATCC
     AGCCCAGACTCCAGTTTGTAAGAGGAGGAGACATAATAGTGGATTCAAATGAGCTAAGGAAACACTACAGGACTTACAAAAATTT
     CAGTTGGATGTCGCATCAATAATACCATTTGATATTTGCTACCTCTTCTTTGGGTTTAATCCAATGTTTAGAGCAAATAGGATGTT
     AAAGTACACTTCATTTTTTGAATTTAATCATCACCTAGAGTCTATAATGGACAAAGCATATATCTACAGGTTATTCGAACAACTG
     GATACTTGCTGTTTATTCTGCACATTAATGCCTGTGTTTATTACTGGGCTTCAAACTATGAAGGAATTGGCACTACTAGATGGGTG
     TATGATGGGAAGGAAACGAGTATCTGAGATGTTATTATTGGGCAGTTCGAACTTTAATTACCATTGGTGGCCTTCCAGAACCACA
     AACTTTATTTGAAATTGTTTTTCAACTCTTGAATTTTTTTTCTGGAGTTTTTGTGTTCTCCAGTTTAATTGGTCAGATGAGAGATG
     TGATTGGAGCAGCTACAACTCAGAACTACTTCCTGCGCCTGCATGGACAGAGAACCATTGCCTACATGAACAATTACTCCATTCCT
     AAACTTGTGCAAAAGCGAGTTCGGACTTGGTATGAATATACATGGGACTCTCAAAGAATGCTAGATGAGTCTGATTTGCTTAAGAC
     CCTACCAACTACGGTCAGTTAGCCCTCGCCATTGATGTGAACTTCAGCATCATCAGCAAAGTCGACTTGTTCAAGGGTGTGATA
     CACAGATGATTTATGACATGTTGCTAAGATTGAAATCCGTTCTCTATTTGCCTGGTGACTTTGTCTGCAAAAAGGGAGAAATTGGC
     AAGGAAATGTATATCATCAAGCATGGAGAAGTCCAAGTTCTTGGAGGCCCTGATGGTACTAAAGTTCTGGTTACTCTGAAAGCTGG
     GTCGGTGTTTGGAGAAATCAGCCTTCTAGCAGCAGGAGGAGGAAACCGTCGAACTGCCAATGTGGTGGCCCACGGGTTTGCCAATC
```

TABLE 1-continued

Sequences Table. First column: SEQ ID No. Second column: corresponding mRNA sequence. For the 3 different groups, see explanation in the text.

| | |
|---|---|
| | TTTTAACTCTAGACAAAAAGACCCTCCAAGAAATTCTAGTGCATTATCCAGATTCTGAAAGGATCCTCATGAAGAAAGCCAGAGTG
CTTTTAAAGCAGAAGGCTAAGACCGCAGAAGCAACCCCTCCAAGAAAAGATCTTGCCCTCCTCTTCCCACCGAAAGAAGAGACACC
CAAACTGTTTAAAACTCTCCTAGGAGGCACAGGAAAAGCAAGTCTTGCAAGACTACTCAAATTGAAGCGAGAGCAAGCAGCTCAGA
AGAAAGAAAATTCTGAAGGAGGAGAGGAAGAGGAAAAGAAAATGAAGATAAACAAAAAGAAAATGAAGATAAACAAAAAGAAAAT
GAAGATAAAGGAAAAGAAAATGAAGATAAAGATAAAGGAAGAGAGCCAGAAGAGAAGCCACTGGACAGACCTGAATGTACAGCAAG
TCCTATTGCAGTGGAGGAAGAACCCCACTCAGTTAGAAGGACAGTTTTACCCAGAGGGACTTCTCGTCAATCACTCATTATCAGCA
TGGCTCCTTCTGCTGAGGGCGGAGAAGAGGTTCTTACTATTGAAGTCAAAGAAAAGGCTAAGCAATAAATGTTTGATTATCTTTAG
ATGTGATATAGCTAGTTCCCAAAGTGATTGTACCTAGGATTGTAACTTAAATTAACGAGGGGAAACGACATGCTGGGACCCTTGAG
AAACGAAAGGCAAATCCCTAGCTTAGTTTCTAGGACTTATCTGAGAGTGTGATTTCATGCAGTGGTAATAAGAAGATTATTAAAAG
CCATCCCTATTCTCCGTTTTCATTAACTTTATGCAATTGCTATATCTTCTAATTGTATGTAGTAAGTTTCCTTTTCCTTTGGTTCT
TTCCTGATGATGTCTCTTCCTTCCAGTTTTATTAGCTTGCTCTTGGCTGTGATGTGATTCACTAACCTTTTCTCTTAATTTTTATT
GTGTTTAATTTCTTCTTTGGCACTCTAAAGCCTGGCTAATTGTTCTAGGTTTATGAATTTCACCTCTTACATGTAAAGGGTATAAG
ATTTTAATGTAATAGGTCAAAAATCAGATTATTTTCATTCAAATGAGGATGATGAGTCACTGTAATATCAAAAAATCCCCAGCAGC
TGGGACTGAAGGGAAGCAGAGATCATGAAGCTTTCTGAATGAGAAGTCTGATTTTTGGAACAGTCCCCTGAAGACCAATGTTGGTC
GGCAGAATTAGCAAACTGGCAAAATCACATTGCAGGAACATATTGGAAAAATTGTACCCTTTACTAAAGAAATAAACTTCAATATT
TTCTCTTCTAACCAACTTAAAAGACACCAATCTACCTAACTCATCTGGCTCAAGGGACTTGGACTGGAGGATACAGGCTAAAGTGA
CACTTATCAGAATCTTCCTCAAGCACTTGCTGGAAAAGATATCAGATTGGAACTTCTTGTTTAAAATTAAGCTTTAGTAAAACAAA
GTGATGAGGTTAGGAAGGCAGACTCTACACATGTCAGATTGACATATCCCCACAATTTCCGGAACCTACATGTATAGCTGTTTACA
AAATCTCCAAGTTAATTAAGGGCACTTTAGAAGTTGTCCTCATGAATTAGCTAGCATTAGCATAATTACCGACGTTGCATGCTGTG
AGGAGGCTACAAAGGCCAGGCTGGTGTCGGAAGTAATAATACATATAGAAATTCCATTCTAATAAATGCCATTAGTGTATAACATC
AAGTTCTGTGTAATGAGGCTATTTCCAAGTCCCCCAAAGATGGTCACTGTTACAGCACTTTGCTGAGAGGGTTTTAACAAATCATA
TTAGCCAAAAAGCCTACAACATAGATGCATTTAGCAAACATGTCACAATCAATCACTATAATAAACTGCATCATTTGATAGAGTC
ACCGTTTTTGCATGTAGTGTTAGAGTATCACAAAATATAACAAGTTTTACTAAAGGATGGTTGGTTTTTTCAGGATTTAAGGGAAT
ATGGACAAATTGTTAAATAGTATTTATTTGATAAATGGGAGTTTGTATGCAGAAAGAGTGAATTGCGTATAAAAAGGGTGATTTAA
AAACCCAGAAACAAAAGGTAGAATAGGGCTGAAGCATCTGATAATAGGAAAAAAGGACAAAAGTCCTCAACTTGTGAGCAATA
TGCTTTCCCTTTACACCCTGTAATTTATTCAAATGATATTAAAATACAAGACCATTGCAATTTATGGTTTTCGCCTGGCAGTTATT
TTCCCCCCCAAGCTATCCTGTTTCAGATAATATCAATTTATTTCCAATCCATCAGACTAAAATCTAAGAAAATTCAAGAACTCTTT
TATTGTTGATTTGGTGCCACCAAATTCTTTTTCTTTTTAAATCTTTCTAATTATCCTTTCTTTTTCAATCCCATTGCTAACACCCA
GAACATATTTTCTGTTCAATGCAAATAAACATTCACTTTTTACCTAAAAAAAACAAAAAAAAAAAAAAA |
| 128 | AGAAGGTGGTCATTAGATGCAGTCTTTTCCTTTTTAATCCCCTCTTAGCACTTCTGTGAGTGGAGAGGACATTAAGTAAAATTTGG
AATCATAAGTTGCAATGCAGTAAAATGGTGCTGGGGAAGGAGCCAGTTAGTGTTTCTGTGAGTTTGTGTTGTGATGCAATAAGAGA
TAAGTAATGCAGAGAGAAATGAACCATGGAAAGTAAGAACACTGATGGTGATTCCTCTGCAAAGATGATAAGAAAAAGAACCAATA
AATCACACAATCTTTATGTGCTTTCTATATGTATTTCTTAGTAGTGATACCATTGATCCTCTTACTTTTTTTACTCCATTAATACT
AATAATTATATACTTTGCTGAGGATCAAAACAGCCAAGAAAGGAATTACTGCTAAAGCATCTAAGATTCTCCTGAACTGTAAAATC
AACAGGAAATGGCCACTGGGAGAGAAGGATTTGGTATTGGGTGAGGGGCTTTCTCCCTTTACCTGCCTCTTCTTGCTTGCTAATAG
TAAGTTCTTTGTGCACCTTCCACCACTTCTGAGCCACTACTATTCAAGTAGAGATTTGCCCCAACACATTAACTTTTTCCTTGGAG
ATTTATATGGTCCTGCATTTTGTCCTGTGCTCACAATGTGAAGTGTCTTCTGTATTCAAATCAAAAATAATATATTTAAGGTATA
TAAGTGTGAATCTCCTATAATGATGGAAGAAGAGGTTCTCTTGTCTTAGATAGAAAAGAGCCTTCTCCAAGAGCAATGTCAAAACT
TGGGCTGTCATCTTTGAGCTGTTTACCAAAATACAGACCATTATTGAAGAAAACAAATTATCTATTTTGTTTCCCCCATCTAAT
ATGATAGTGCCCCCAACCAGGTTGTAGCATTGCCTTTTAAAAGAGACTCACTCACTCTTAGTTTTTAAGAACTGGAAATTTCCCAT
CCTCAGATCCCTTAAAGGATGAAGAGTTGGCTGTACACTTAAGCGGCCTTGCCTCTTGTATGCAAGGACTACGATTGAAGTCTGTT
TTGCTGTGTCTGGTTATGTTGTCTGCACTTTTATGAAATCACTACAATAGGCTGCATTGGAAATGACTATTAATTTGTAAAGAAG
TAAGTTTTATTAAACACTGTCTAGAAAAAGAAAGTGAAGCTGAGAACTCTTCCTTTATTGTCATTTATATTTTCTGCTGAATTCC
GGTAGTTCCCTTTAAAGTCATGTTGACTAATGTTTTCCTCCTTGTTTGTATTCAGATTTCCAAAATTTCACTCATACAAGGGAAGA
GACTCCATTTAGCTTAACGGTAGTCTTTAGATCATAAGAAATATATAAATTAGTATGCACCTTATCTGCCTGTTGTGGGTTTCTTA
AACTTGCACTTCCTACCCACCCAAAGATAGATATCCTTTAAAGAAAATAAAGGCAGAGAATTAAAACTGGGGAGCCATTTACTATG
TCACCATCACTGTTAACTGTTTCCCAGCAATCTAAACTTTTTGAAGTTTCAGAGGTGTATTTTTTTTTGTATATATGTCTGTGTG
ATTGTATTGTTTTGTTTCTAAATATACAAGGAATTCTTTAAATAGAGAAAAAGGTTAATCCTCACTGAAACACCAGGATGCCCACT
GGATATACTAATCTGAACATCTGTAGGTAGTTTGTCATGAAAAAGTGAGAGAAGATGAGACTTTTGAATGAATGAAAAAAGGGTAT
CTTGATACCCAGAATTCCCCCCAAAGTACGGGTAATTCAACCTGCACAGTTTTCTTTCACTCAAAGTGTTCAGCACTTGTGAGTGA
AAAATCATGTAATTATCTGTAAATATGTAGCTAACAAATTGACCTAGTTTCTGTATTTTTTGTTTTTGTACTAAAGTTTATAGGT
CTGTGCCAGCTAGAGAGAAGTTGCTGTCATTACCAGTTGTGGTCCTAGCATCTAACCCTGAAACCATCCTAGGTGACATTTTTAGA
ATTAATACTTAAATGTTAAACAGGGGGAAATGAAGCTTAATCATGGCTCAGGTTTGAGATCTTTTGCAGTGAAATAATTTTATTTAA
TATAAATGATCACATGTCCTCAATCATGAATGAGGTAGGGAGCCTCTCTCCCCCAGTGGCCATGTTTACAAAAGTGTGTTTTGTCT
ATAAAGTGCAAGTGTTTTAATGTTTATGTAAATTATGCAGGTGATAACATGGTTTGGAACTGTTTATTGGGCTCTTTAACTGAATT
TTCAAATGAAATGAACTATGCTTATTGCTGGCACATTGATCCCATTTCTGGAACATTTTTCCTATTTCCAGAGTTACATATGTTCT
TTTGTCATTACCCAATTTAACCTCCCTTTCTCTGATATGCCTTGTAGCCAAAGTATTAAAGGCTGATGAACATAGACAAGGGAAAT
GCATTTCTTAGAAATCCGTGAACCCTCAGTTGTATGCTTTCAGTACTCGTGTTAATATGTTTCTATGGCAACTCTGAGGTCAGTGG
TTTAGAAATGAGATACCAGTGTTAATGAAAAGTGTGTGCTCTTTGGTTTTGCATGGCTTGGCTTAGTATCCAAGGTATATTAGGGC
CACTTGAAAGCATGAAGACCAGTTATATAGGGAACAGGTTTCTCTCAGTGGCACATTTTGCTTTTTCTGAGCCCCAGATACATTGC
CTGGGCATGAACATTGTTACCGTAAATTGCACATGGTCATGGACTGAATTATGTGACTTTAAAGGATGTAACTGCCCAACATTTGC
AGATTCTGGGTGGTCTATGTGACCCATTTGTCTCGTATCCAAAAACCCCGGGCTATTGGAACCCTTCCAACACTTTTCCTTTGTC
ATAGACAAGTTTATATATAACTTACCAAGATGTTGGCTGTCCTGGTGTATTGCCAGACAGCTCTCTTTTGGTTCCCATTCCAAATG
TGCTGCTGTCCTTCTTTGCATTTCACAATATCAAGAAACCACCACCCTTCTGCCTAACAGCATTTTATGCCTTTTATTCCACATT
AAATGGGAATTGTGCCTACTTAGGAGTGCCCCTCCAATTAATTACATGTGTCCAAGAATAATCCAAGCTAGAGACACAAGGTGGGA
AAACATTTCAAAAAAAAAAAGTCCTCTTAAGGCCGTAATTTATCTGAAAAGGTATTTTATCACACCTTGACACCTTATATATGA
GCCTATTAGGAGCTGCAGGTGGTTTCATAGGGTAAAATCCAAGAAAAGAGAAGGATGTGTGGGGTTTCTATTAGAAGATAATTTTG
TTCTCATTTTACCTTTTCTTTTATGATCCTTCTCTGCTAGAACAGGTTAATTCTCCAAATTTGTTTTGTTTGTTTGTTATTTTT
TAGGGAACTCTTTTGCAAAAGCAATGGTCGGATGTAAATAACATTTAAAGTATAGTGCACATAACTTCCCCGGACTGTTCCAATCT
GATAATTTGTAAATGCTTTAGAGTTTTTTTAATTAACACTTGTGTTGCTAAATTCTATTTATGTAAGTCTGCTAAAGTTTTTTAGC
CCACTTAAAACTTAAGACACCATTTAAAATAATGGATGGGTTACTATGAGCAATTTCGCTTTCGAACCCCCTTGTTTTAGTATA
TGAAAAAGCCTAATGCGCATTAATGAGGTTGAAGAGACTATGAGAAATATGTATAGTGTATATTTTAAAACAGCTTTGCTTGTATT
GTGAAGATTTAAAAACAAACTTGAGATTTTTAACGTAACTATTAACACAGTTTTAACATAAGTTATCCCACTGGGTTTAAGAGCAT
CTTGAATGTATAATCCTTTTTGTAACCCAGGTTGGTTTCTACTTTTACCAGTCACCCAAACATATTTATGTTTTTAGTTTTATGTA
CTCATTTCCCTTTGTTTTCCTCAAACAGCATGATTTTTTGCACATGTAGAAATTTTTAAAAGAAAGAAATTAGTACATCATTTT |

TABLE 1-continued

Sequences Table. First column: SEQ ID No. Second column: corresponding mRNA sequence. For the 3 different groups, see explanation in the text.

```
    CTCTGGATTTTCTTCACTTCCCTCTTCCTTTCTACTAACTCCTTCCTTAAAGGCCATATCACTCCATTTGCATTATTTGTGCAAAT
    GCCAGGGTTGGTTTTTATTTTTATTTTTGCTATTTACCTAAAAAAAGAAAATGCTTCAGTCAATTGCTTTTTTATTTAAAAAAAAA
    GAAAAGAAAAAAAGCTGTAACCTTATCATTTCTGAGTAGACCATTGAGCGATGAATGCACACCTGTAGTAGCCCAGGACCAGCTGT
    GGTGGCTAAAGGGAATATGTTAATTAAGCAAGAGGTTCTTTTCTAAAAGTGGTATCTGTTATCCACAATGTATTTTAGTTATTCCC
    ACAAGTCAGGGGTCCAGATAAAATGAGGGTTATCAGCTAACTGATATGCTATCATTGAGGTTCATCAATGAATTTGTACATTTCTA
    GTTCCCTTTGGTGAAGGGAAAATGATGATTTTGCAAGACCTAGATTTTGGCTTGGTTTCTTGCCTCCTTTTTTGGCAGCCTTCAT
    CTTCTCATCTCCCAAACCCCTGAGCCCGTAGGGTTTTCATAGTGGACAAAGAACTTGTGGTCTTTTAAAACTGGGACTGATACTT
    TTTTGAGAGAGTATCGTGTCGAAAGTGTGATGTTCTACCACTTTACCAATAACTAATTTTAAATACACATTGTCCTCTCGATTTTT
    GGACCAAACAGACGCTCACAGTGGAGGCTTATCAAGGGTTGCATTGGGGAAGAAGCCTCTCCCTCTCTGTCAGCACCAGCTGGTAA
    AGGTGACTGTACAGATGTGCATTTTCCTTTTGGTATAAATGGTCCACAGCACTAACTGGTAAGGCTTATTGTACAGTATATTGTCA
    GTATTCTTCTGGTTCAGCATACCTTATAGTTCATATATAACCTGTATTAATTGTATAGATTGTGCATTAAAAGCTGTTACCAAGTT
    GTCAGAACATAAGAGCGAAAACAAGGTCATATGTAATATTTTGTTTGTAAGTATCCTTTGTATCATAGCAAAGGAAATGTTTAAAA
    AAATCAACTGTAATAAAGTAATTTTAGCAAAAAAAAAAAAAAA

129 AAATTTAGAAATTTATTCTGTTTAATCCACAAGCTTTATATAGCTTTAGTTTAAAAAAAATCAAAACAAAAAAAAAAATCAAAACA
    AAAACAGTGAAACCAANGACACTATTCCAAAGTCTGGGCCCTTCCAGCCTTCCAAATACAAGNGGCTCTGAAAGTTGTATATACCAN
    TTGGGNGGGANCANGGACAAAANTNTGGANCAGGGNCCATGGACATTTCATTAAACAANTTGTATGGTAACTGAGGGNTCCTTTCG
    GGGGNCTAGGCTCATTGCCTTTACAAAGGGAAAAAANCAAANCAAAAAAANCAAACCCGGTTTACGGGTGGGGGGTCCCGGTGTT
    TCCCNATTCACTTGGT

130 TTTTTTTTTTTTTGCAGCCAGCTTGCTGTTTACTTTCAACTCAAAGTGTTTTCTGTTGTATATCCATGTCATCACCTCTTATTTAT
    CAGGAAGTGACACAAAGTAACAGGCTTCACAATGCCATCAATGTCATTTTGACAGCATTCATGTCACAATACACAATCATGTACTG
    TAATTATACAAAATCCAAAGGANTAAAATGTTACTAGTTACACTCGTTAAAATGTAAACTGGACAACCAAANGGANATAACAAAACA
    AAAAGGAAATCTCTGATCAGGANTCCATAGGGGACATTTGGACAATNTTACAAAAAAAGGTGTTCAAATATTTGGTCCCGGCATGN
    CTGGCGNTTCATTGGCCNTTAACTTTCATTAATTCCCCGGCTCTTTGGGGGGGG

131 AACATAACGCCAGCCCCAGAGCTCAGGTGAGACCTCTAGAGAGAAAGCTCGCAGGTACCTCATCCGCATGCTGTTATTATCTGCCA
    GCCCACTTATCCAGGAGCTCGGTCCTCAGCGGGCTGCGCGCACCGCGCGGAAGGGCGCATCTTCACCTCGTGGCTCTGGCGGCAGA
    GACGCGCGGGGCTTGCTCGGGAGCGAGGAGCGAAAAGTTGTCGCCCACTTGGGTAGGGGGAAAGAGAGCGATCGAGCCAGCGCGG
    GAGAGCGAAGGGGGAAGGCGGGGAGGGGGCGGGAGGGGGGACTGCTTACATGAATTTCCAAGTGGTAGACTGCCTCTGCGCTCT
    GCCCAATGAGATCCGTCAGGGGAGGCACCCGGCTCACTTTTCCACATCACTTCACAGTTACATTTGGCAGGCAGGCGGGCTCGCAC
    GCCGGAGCGCTCAGCCCAGAATTAGTGGATTTATTTGGAATCTCCCTGCCTCCTCCAAGCTCCGCCGCCGCCGCCGGCTTGTGCAT
    AGACGGTAGCGTCAAGACACCAGCTGCACTTTGGGTTGCGGACACCCAGAGCCCAGCGCGCCCGCCCTGCGTCTCCGCACCAAGCC
    CTGTAGCTCCGAGAGGCATGAACGGAATCCGGAGGCGCCTGCCTAGCGAGCGAGGACCGGTCGGCGCTTGCCGCCCTCGGGAGCTA
    ACCCCGAGCACCTCCAGCCATTTGTGAACCTGGAGGCTTGACATTCGCCAGCGCAGGGCCCCACAAGAGAAATTTCAATGAAAAGA
    AAAGCCAATGGATTGTGGTCTTAGAAAAGCTGCTTAGATGATGTCTGTTTCCCGTGCTATAGACACGTGGCAGAGCTGTAAGTAAA
    TGCTCGGCACTGCATGATGAATTGGATGGCTGCAGACCGGAGACAAAAAAAATAATTGTCTCATTTTCGTGGTGATTTGCTTAACT
    GGTGGACCATGCCAGAACGGCTAGCGGAAATGCTCTTGGATCTCTGGACTCCATTAATAATTATTGATTACTCTTCCCCCTTG
    CATTTACATGGCTCCGATGAATCAGTCTCAAGTTTTAATGAGTGGATCCCCTTGGAACTAAACAGTCTGGGTGAAGAACAGCGAA
    TTTTGAACCGCTCCAAAAGAGGCTGGGTTTGGAATCAAATGTTTGTCCTGGAAGAGTTTTCTGGACCTGAACCGATTCTTGTTGGC
    CGGCTACACACAGACCTGGATCCTGGGAGCAAAAAAATCAAGTATATCCTATCAGGTGATGGAGCTGGGACCATATTTCAAATAAA
    TGATGTAACTGGAGATATCCATGCTATAAAAAGACTTGACCGGGAGGAAAGCTGAGTATACCCTAACAGCTCAAGCAGTGGACT
    GGGAGACAAGCAAACCTCTGGAGCCTCCTTCTGAATTTATTATTAAAGTTCAAGACATCAATGACAATGCACCAGAGTTTCTTAAT
    GGACCCTATCATGCTACTGTGCCAGAAATGTCCATTTTGGGTACATCTGTCACTAACGTCACTGCGACCGACGCTGATGACCCAGT
    TTATGGAAACAGTGCAAAGTTGGTTTATAGTATATTGGAAGGGCAGCCTTATTTTTCCATTGAGCCTGAAACAGCTATTATAAAAA
    CTGCCCTTCCCAACATGGACAGAGAAGCCAAGGAGGAGTACCTGGTTGTTATCCAAGCCAAAGATATGGGTGGACACTCTGGTGGC
    CTGTCTGGGACCACGACACTTACAGTGACTCTTACTGATGTTAATGACAATCCTCCAAAATTTGCACAGAGCCTGTATCACTTCTC
    AGTACCGGAAGATGTGGTTCTTGGCACTGCAATAGGAAGGGTGAAGGCCAATGATCAGGATATTGTGAAAATGCACAGTCATCAT
    ATGATATCATCGATGGAGATGGAACAGCACTTTTTGAAATCACTTCTGATGCCCAGGCCCAGGATGGCATTATAAGGCTAAGAAAA
    CCTCTGGACTTTGAGACCAAAAATCCTATACGCTAAAGGTAGAGGCAGCCAATGTCCATATTGACCCACGCTTCAGTGGCAGGG
    GCCCTTTAAAGACACGGCGACAGTCAAAATCGTGGTTGAAGATGCTGATGAGCCTCCGGTCTTCTCTTCACCGACTTACCTACTTG
    AAGTTCATGAAAATGCTGCTCTAAACTCCGTGATTGGGCAAGTGACTGCTCGTGACCCTGATATCACTTCCAGTCCTATAAGGTTT
    TCCATCGACCGGCACACTGACCTGGAGAGGCAGTTCAACATTAATGCGACGATGGGAAGATAACGCTGGCAACACCACTTGACAG
    AGAATTAAGTGTATGGCACAACATAACAATCATTGCTACTGAAATTAGGAACCACAGTCAGATATCACGAGTACCTGTTGCTATTA
    AAGTGCTGGATGTCAATGACAACGCCCCTGAATTCGCATCCGAATATGAGGCATTTTTATGTGAAAATGGAAAACCCGGCCAAGTC
    ATTCAAACTGTTAGCGCCATGGACAAAGATGATCCCAAAAACGGACATTATTTCTTATACAGTCTCCTTCCAGAAATGGTCAACAA
    TCCGAATTTCACCATCAAGAAAAATGAAGATAATTCCCTCAGTATTTTGGCAAAGCATAATGGATTCAACCGCCAGAAGCAAGAAG
    TCTATCTTTTACCAATCATAATCAGTGATAGTGGAAATCCTCCACTGAGCAGCACTAGCACCTTGACAATCAGGGTCTGTGGCTGC
    AGCAATGACGGTGTCGTCCAGTCTTGCAATGTCGAAGCTTATGTCCTTCCAATTGGACTCAGTATGGGCGCCTTAATTGCCATATT
    AGCATGCATCATTTTGCTGTTAGTCATCGTGGTGCTGTTGTAACTCTACGGCGGCATAAAAATGAACCATTAATTATCAAAGATG
    ATGAAGACGTTCGAGAAAACATCATTCGCTACGATGATGAAGGAGGAGGGGAGGAGGACACAGAGGCTTTTGACATTGCAACTTTA
    CAAAATCCAGATGGAATTAATGGATTTTTACCCCGTAAGGATATTAAACCAGATTTGCAGTTTATGCCAAGGCAAGGGCTTGCTCC
    AGTTCCAAATGGTGTTGATGTCGATGAATTTATAAATGTAAGGCTGCATGAGGCAGATAATGATCCCACCGCCCGCCATATGACT
    CCATTCAGATATATGGCTATGAAGGCCGAGGGTCAGTGGCTGGCTCCCTCAGCTCCTTGGAGTCCACCACATCAGACTCAGACCAG
    AATTTTGACTACCTCAGTGACTGGGGTCCCCGCTTTAAGAGACTGGGCGAACTCTACTCTGTTGGTGAAAGTGACAAAGAACTTG
    ACAGTGGATTATAAATAAATCACTGGAACTGAGCATTCTGTAATATTCTAGGGTCACTCCCCTTAGATACAACCAATGTGGCTATT
    TGTTTTAGAGGCAACTTTAGCACCAGTCATCTATAAACTCAACCACATTTTAATGTTGAACC

132 CCAGCGGCTGGGCTGAGCGTCGAGACTCGGGGCCGAGGCGGAGGAGCGGCCGCCGCGCCGGGGCCCAGCCGGAGCCGCCGCCCTC
    GCCCTTGCCTTTGCCTGCGCGGCTCAGAATCACCATCCGCGGCGCGGGAGACGAGCCGGCCGTCCCGGGCCGGGGACCCGCCCGC
    CATGCCCACCAAGGCTCGGGTTATGTATGATTTTGCTGCTGAACCTGGAAATAAGTGACCGGTTAATGAAGGAAAATCATCA
    CAATCACAAATCCGGATGTAGGTGGAGGATGGCTGGAAGGAAGAAACATCAAAGGAGAACGAGGGCTGGTTCCCACAGACTACGTT
    GAAATTTTACCCAGTGATGGAAAAGATCAATTTTCTTGTGGAAATTCAGTGGCTGACCAAGCCTTCCTTGATTCTCTCTCAGCCAG
    CACAGCTCAGGCCAGTTCGTCGGCTGCCAGCAACAATCACCAGGTTGGCAGTGGCAATGACCCCTGGTCAGCCTGGAGTGCCTCCA
    AATCTGGGAACTGGGAAAGCTCAGAAGGCTGGGGGCCCAGCCAGAGGGGCTGGAGCCCAAAGAAACACAAACACTCCCAACAAC
    TGGGACACTGCCTTCGGCCACCCCCAGGCCTACCAAGGACCAGCAACTGGTGATGATGATGACTGGGATGAAGACTGGGATGGGCC
```

TABLE 1-continued

Sequences Table. First column: SEQ ID No. Second column: corresponding mRNA sequence. For the 3 different groups, see explanation in the text.

CAAATCCTCTTCCTACTTTAAGGATTCAGAGTCAGCTGATGCAGGCGGCGCTCAGCGAGGAAACAGTCGTGCTAGTTCCTCATCCA
TGAAAATTCCCCTTAACAAATTTCCTGGATTTGCGAAACCTGGCACGGAACAGTATTTGTTGGCCAAACAACTAGCAAAACCCAAA
GAGAAAATTCCCATCATTGTTGGAGATTATGGCCCAATGTGGGTTTATCCTACCTCTACTTTTGACTGTGTGGTAGCAGATCCCAG
GAAAGGCTCCAAAATGTATGGTCTAAAGAGCTACATCGAATATCAGCTAACACCTACTAACACTAATCGATCTGTAAACCACAGGT
ATAAGCACTTTGACTGGTTATATGAGCGTCTCCTGGTTAAGTTTGGGTCAGCCATTCCAATCCCTTCTCTTCCAGACAAACAAGTC
ACAGGCCGCTTTGAAGAGGAATTTATCAAATGCGCATGGAGAGACTTCAGGCCTGGATGACCAGGATGTGTCGCCATCCAGTAAT
CTCAGAAAGTGAAGTTTTCCAGCAGTTCCTAAATTTCCGAGATGAGAAGGAATGGAAAACTGGAAAGAGGAAGGCCGAGAGAGATG
AGCTGGCGGGAGTCATGATATTTTCCACCATGGAACCAGAGGCACCTGACTTGGACTTAGTAGAAATAGAGCAGAAGTGCGAGGCT
GTGGGGAAGTTCACCAAGGCCATGGATGACGGCGTGAAGGAGCTGCTGACGGTGGGGCAGGAGCACTGGAAGCGCTGCACGGGCCC
ATTACCCAAGGAATATCAGAAGATAGGAAAGGCCTTGCAGAGTTTGGCCACAGTGTTCAGTTCCAGTGGCTATCAAGGTGAAACAG
ATCTCAATGATGCAATAACAGAAGCAGGAAAGACTTATGAAGAAATTGCCAGTCTCGTGGCAGAACAGCCAAAGAAAGATCTCCAT
TTCCTGATGGAATGTAATCACGAGTATAAAGGTTTTCTTGGCTGCTTCCCTGACATCATTGGCACTCACAAGGGAGCAATAGAAAA
AGTGAAAGAAAGTGACAAACTAGTTGCAACAAGTAAAATCACCCTACAAGACAAACATGGTGAAGAGAGTCAGCATCATGT
CTTACGCGTTGCAAGCTGAGATGAATCACTTTCACAGTAACCGGATCTATGATTACAACAGTGTCATCCGCCTGTACCTGGAGCAG
CAAGTGCAATTTTACGAAACGATTGCAGAAAAGCTGAGGCAGGCCCTCAGCCGCTTTCCAGTGATGTAGGACAGAACGGGCCTTGA
AGAGAATGCCGCGTGCTTTCTCCTGACTTGGGGCAATGCAATTCAAAACTTTTTGTCCCCTATTATTCAGAAAAAAAGGAAACAA
AACCAAAAAGAAAGAGTTGCAAAAAACTGCATTTATTTTATTAGCACCTTAAGTGCGTCAGTTATTTAGGGATGGTCTTTTGTTC
ATTTCCGCATCCATTATTTAAACCAGTGGAAATTGTCTCTATTTTTGGAAAGTACTTAAAAGTTACCAGAATTTTCAATGGAAAAT
GAGGGGTTTCTCCCCACTGATATTTTACATAGAGTCATAATTTATATGTCTTATAAATTATAAGTCTTATATAATTTATAAGTCTC
CCACAATCTTCCAGTTCTTACCCAGTGTCAGATAATTAATTACTAATTACTTTCTTAAAAACATGAACTATGCCAGAATAAAAAAT
ATCTATCTTTGTATATTTTTATAACTCCTTTCAGTCCTTCTGGGGCTCCTGTCATTGAGGGAAGTCGTTACGCCTTTCACTGCCACA
GTTACAGCTCAAGTGCTTACACTTCAAGAGGGAGGACGCTGGGGGCCCCTGGGGCTGCTAGTGCCATCGTGGTGTGTGGCAGGTGG
GCCATCCCATGTCCCTCCAGGGGGACCCCACAGCCTGGCAGATGAGCAGATACCCCTGGCCACCCATGTCCTCAGCGACATTTCTG
ATGTGCTGCTCTTATGTGAGGACCAGTGCTTTCTCTCTTTGCACTTCCTTCCTAATCTTGGTTAAGGCATGTTTTATGCCATGAAG
AATACATTAGAAGAATTGAGGGACTTTGTAGAGAATTTTGTGGCTTTGGCTTGCAACAGGTGAGTGGCTGTGCGGAGGCCTGTGTTCG
GGAGGGCCTGGGAGAAGGAGGGCACCCAGCACCCCGGCGTCTCTGGCCGTTTCTTATTCTTTGGCTCCTCATCCACCGTGATGAGA
AGCGCTGCTGTGGCCACGGCACACTGCTTGGCTTGGGTGGCGGGTTCATGGCCAGTTGGTGTCATCAGCAAAGAGAAAAAGCACAG
GTTAGCTCCCCATTAGATGGAAAAGTGTAGGGACTGAGAAGGGCTGCAGCCTCAGCAGTGTACAGAGTCCCCGGCGCTCTGAGGTT
GGAGAGAAAGAACAGACCAGCGCCCTTCCCGACTACATCCGAAACTTCACACAGGGTGTTTCTGAGCACCAGCACTTCCAGCGCTT
CACTTAACGGCATAAAGCAAAACAGGACCTTGGCACACCGTCAGCTCGAACTCAACACTGGCAGCCACCGTCTCACCCCTGCGGAG
GAGCGCTCCCGTCTCCCACAGGTGCCTTACCGCGTTCCCTCCCGCTGCTTTCATTTTTCTGACCTAATAATTACGGGAAATGGAAA
GTCTGGGCCAGCATCAATAAAATGACACCAAAAATAAGTAGATGAAATCAAATGAATATGAGAACATCTTGTTCTTCAATATCACG
GGTTTTTGTTAATGTTTCATAAGTAATTCTCCCCACTTGATTTTTCTTCTATAAAATCCCATAGAACAATGTTTATGCTATAGCCA
TTTAATATATGTACAAATTGTAAAGAATATGTATAAATGTTTTACACGAATGTAAGACATGTAGAAGCCAACATATAAATAAATT
GTTTAAAAAAACTGTACAGTAAATTCTCAAAGCACTTTTTCAAAACACTTTTTGGACTTTGTGTGTGATTTTTGTTGTTGTTGTTA
AGTACTTTTTATTCCAGCTGCTGAAAATGGTCCAGGTAATGAATTCTTCCCCAAATCCTATTTCTTCTGACATGAATTCATCATTT
CAGTTCCGTAGGTCAGTGTTGCGGTCCGGGAAGCGTATCATAACCACCTGGGAGTTGCCAAGAAGCAGACAGTCTCCCAGTGTCTG
ACTCTCGGATATTTGGATTTGACTGGTGTGAGGCAAAGTGAAAAAGGGATGGGGGAAATGGAGATGGCACGGGCTCCTCAGAGCGT
GGTAGCCGACTGTGAGGAAAAGCAGAGGGAATGTGAAAGAAAATAAGAGAATCCACGGGATTTGATGCCTGGAAGATTCTCCTTCA
AGTGGCAACATGGCATATATATCCTTCTCCGGGGAGTCACATGCACCATTTGGTTCTTAGATACGTTGATGTTTTGATTTTTAATG
ATTTGTATCAACCTGTAGGTACCACAGAAGAGCTGTAGTCATACAATCACATAACTTTTACAAATATAGTGG

133 TGAGGGGATCTGACGGACCCCTGACAAATTCAATTTCTTTCCCATTCCGGGCCCTTCCCTATCGTCGCCCCCTTCACCTTGGATCA
TGTGCAAGAACAAAATTACTTGGCAGATTTGATGAAAAGAAAATGTGTCCAACTGCATCCAGTTGAAAACTTCAGTTATTAAGG
GTATTAAGAATCAATTGATAGAGCAATTTCCAGGTATTGAACCATGGCTTAATCAAATCATGCCTAAGAAAGATCCTGTCAAAATA
GTCCGATGCCATGAACATATAGAAATCCTTACAGTAAATGGAGAATTACTCTTTTTTAGACAAAGAGAAGGGCCTTTTTATCCAAC
ACCTAAGATTACTTCACGAAATATCCTTTTATCCTGCCACACCAGCAGGTTGATAACAGGAGCCATCAAATTTGTACTCAGTGGAG
CAAATATCATGTGTACAGGCTTAACTTCTCCTTGGAGCTAAGCTTTACCCTGTCTGCAGTAGATACCATGGTTGCTATCATGGCAG
GAAGGGACAAACCAGCATGCTCTATGTTGTGGGAGTCATGACAGATGTCTGCAGACGACACTCGAGACAGTCCCCAAACGGAATCT
GGCCTTGCAACACTACTCCATTACTTTTCACTGATGGGGCTGTTGCCTATCTGACGGACTCTAACACTGCAGCTCAAACGGGCATGCC
CCTGGGGCTAAATATGGCTCTGGGGACGCACACGGCGCACGCACACCGTGTGTTGACACACTAAATAAGGCCCGAGGAATGACGAT
AACATTCCACCGGCATGGCACGACTCCAGCAGCACAAGAGAGCAACAAAAAAAACGTCGGGCGCAGCAGACTAGAGAGTGTGAACA
GACGAGCAGACCGCGGACACACGACGGGCACCACCACGCAGACACCACCACACCGGACTCAAGCCCGGACTCCACACACCCGCGGA
CCCATCGTACCACCGCGTGACGAGAGCCGCACAGAGACGCACAACACCGCGCGGCAACCAGCAGGAGACAGAGAAGAACAAC

134 TTTGTTTGAAAAAAAATGGAAAATTTATTAATTAGACAGTATGTGGGCATCCTGTTCCACATGGGAATGAGAAGATGCTATAGGTT
CTCTAAGTATTGCACAGTCTGAAAAAATAACAAAAAAAGGGAAGGGGAGGAAAAAAAAATCACATGATATTGGGANCCATCTCACA
TTTATGANTAATCTACCAAGAAACATTTAAAAAAGAAAACCCTTTGTTTCTACAGTAGCTTTAAGTTTATAGTTCTTGGGAATGACT
GTATTCCCATTGAAGNCATCTCAGGTAACAGGGGAGGCTGTTTTAGGCCAATCCCCATGGTGGCCAAATATTTAATTAAAAAATAT
TATTAAANTTAATGCCAATTCCATCCTCTTTGCCCTTCACCCCCGGGGCAATCCATGGACCATTTCTGNGGGGACCTGTTTTTGC
CTTNGAATGGGGGGGTAG

135 TGAACTGTAACAGTCGTCTACTGGTTTATTTTTCATATTTTTTAATTGAAAATTGAGCTTGCAGAAATAGCCACATTCTACACATA
GTTCTAATTTTAAATCCAAATCTAGAATCTGTATTTAATTTGTTTTTTAACCTCATGCTTTTTACATTTATTTATTGATGCATGTC
AGATGGTAGAAATATTAAAAACTACACATCAGAATGATACAGTCACTTATACCTGCTGACTTTATAGGAAAGCTGATGATATAAAT
GTGTGTATATATGTTATATATACATATATTCAATACTGCCTTTTTTTTGTCTACAGTATCAAAATTGACTGGTTGAAGCATGAGA
AGAATGTTTCCCCCACACCCAGTTAAGAGTTTTTGTGTCTGTTTTCTTTGTGTATCAGTGAACGATGTTAAGAATCAGTCTCTCTT
TTTGAAGAAAAAGCAATATTCCTTGGAAAGCAAGGAGAATTGAAGGACTATGTTTGCCGTGAGGAAATAGATTTTCATGACTAGTT
TGTTTTATACTTTTAAGGTTGGCACTCTATGTGGGCCTTATATACTCTAAAATGAACTTTGGTCACCTTGGTGCTTATGGGCCATTA
CTTGACCTATGAATCTTTAAGGCACAATCAGTTGTACTTTACATTTAAAGATCACTTGAGTGATGGCCGCCTTTCCCTCCTACCCG
CTCCTTCCCCACATGCCTTCCAAGGTTAGCTGGTAACTGTAGGGCTGCAGGCTGAGGCCATGGTTTGCTGTAACTTGCCCTCACC
CTCCTCATTGCCACCTTAGGTCACTTTATGGGTCTCGTCCTCCAGAGGGTTCGGAAGTGGAGTCTGTTGGCAGCCCTTCCTGCAGGC
CCTAGCACCCTGTCCTGCTCCTTAACTGTGTGTGTGACTCTCCAAGAGAGTTGTCCTGCCTGCTGAAGTGAACCAGTACCCAGAAA
GACAACTGTGAGCCATCTTGGTTTTCACTCGCTGTTTAGCTGAGGTCTTGGGCACAAAAGGGGTTTCACAAACCTCTGGATATAT
CAGAGTTTATGAGAAAGGAAACATGCTCAGTCAAACCAAATCAAACAAATTGAATTTTATGTTTTATAAAGTGCTTCTGAAAGCTA
AGATTTGAAAGAAGTCTGAAATCAAAGTATTTGGCAGCATAACTCCTTAAAGGTAGTGGCGTTGATAGACCATTTTCAGACAGAAT

TABLE 1-continued

Sequences Table. First column: SEQ ID No. Second column: corresponding mRNA sequence. For the 3 different groups, see explanation in the text.

TTATAAAGAATCTGAAAAGGCAGGTCTGTGATAGAGAAATGGACCTGCATTCAGATCCAACTGCCCAGCAAGCGTTTGGATGCAGA
CACTGCTCTGGACGTGGTATACTCCCCAGAGTCCATAAAAATCAGTGCTTATTTTAGGAAACAGGTTGCCCCCCACAACTGGGGTA
AAAGAAGAGAGAAAAGTCACGCTTTTCTCTCATTTCATTGTGTGTGCATGTGTGCGTGTGTGTGTGTGTGTGCTGAGATGTGTG
ATTTTTCTTTCTCAAGGATCATGGCGGGATCACAGAACTCTTTTATACAAGTGAGATCCAGGTCTCTGAATATCTTTTTGTATATA
ATAATAATAAAAAGCTCCTCACCAAATTCAAGCTTGTACATTATATTTTCTTTCTGTGTTTTAAATTTAAGTTTTATTGTTTTGT
ATGTAAATATGTGGACCCAGGAACTGTTATTAATGAGCAAAAGTTACTGTTCAGGGCAGTGATTCTGTTTAATAATCAGACAAAA
TGTAGACGAGCTTTTTAAAGCCATATAGTTTTAACTCTGTACAGTAGGTACCGGCCTGTATTATTGTAACAATAACTCTAGCAATG
TATAGTGTATCTATATAGTTTGGAGTGCCTTCGCTTCCATGTGTTTTTTTTTAATTTGTTCTTTTTTAAATTTTAATTGGTTTCC
TTTATCCATGTCTCCCTGTCCACCCCCTTTCCCTTTGAAATAATAACTCACTCATAACAGTATCTTTGCCCCTTCCACAGTTAAGT
TTCAGTGATACCATACTCAGGAGTGGGAAGAGGAAATCATATTCGTAATTTCATTTCGTTGAAGCCCTGCCTTTGTTTTGGTTCTG
AATGTCTTTCCTCCTCGGTAGCAGTGAGACCGGTTTCATTTCATACTTAGTCCATTCAGGGACTTAGTGTAGCACCAGGGAGCCCT
AGAGCTGGAGGATATCGAATAGATTAAATTTTGCTCGTCTCTTCCACAAGCCCTAACCATGGGTCTTAAAAACAGCAGATTCTGGG
AGCCTTCCATGCTCTCTCTCTCCTCTTTTATCTACTTCCCTCCCAAATGAGAGAGTGACAGAGAATTGTTTTTTTATAAATCGA
AGTTTCCTAATAGTATCAGGTTTTGATACGTCAGTGGTCTAAAATGCTATAGTGCAATTACTAGCAGTTACTGCACGGAGTGCCAC
CGTGCCAATAGAGGACTGTTGTTTTAACAAGGGAACTCTTAGCCCATTTCCTCCCTCCCGCCATCTCTACCCTTGCTCAATGAAAT
ATCATTTTAATTTCTTTTAAAAAAAATCAGTTTAATTCTTACTGTGTGCCCAACACGAAGGCATTTTTTGAAAGAAAAATAGAATG
TTTTGCCTCAAAGTAGTCCATATAAAATGTCTTGAATAGAAGAAAAAACTACCAAACCAAAGGTTACTATTTTTGAAACATCGTGT
GTTCATTCCAGCAAGGCAGAAGACTGCACCTTCTTTCCAGTGACATGCTGTGTCATTTTTTTAAGTCCTCTTAATTTTTAGACAC
ATTTTTGGTTTATGTTTTAACAATGTATGCCTAACCAGTCATCTTGTCTGCACCAATGCAAAGGTTTCTGAGAGGAGTATTCTCTA
TCCCTGTGGATATGAAGACACTGGCATTTCATCTATTTTTCCCTTTCCTTTTTAAAGGATTTAACTTTGGAATCTTCCAAAGGAAG
TTTGGCCAATGCCAGATCCCCAGGAATTTGGGGGGTTTCTTTCTTTCAACTGAAATTGTATCTGATTCCTACTGTTCATGTTAG
TGATCATCTAATCACAGAGCCAAACACTTTTCTCCCCTGTGTGGAAAAGTAGGTATGCTTTACAATAAAATCTGTCTTTTCTGGTA
GAAACCTGAGCCACTGAAAATAAAGAGACAACTAGAAGCACAGTAGAGTCCCAGACTGAGATCTACCTTTGAGAGGCTTTGAAAG
TAATCCCTGGGGTTTGGATTATTTTCACAAGGGTTATGCCGTTTTATTCAAGTTTGTTGCTCCGTTTTGCACCTCTGCAATAAAAG
CAAAATGACAACCAGTACATAAGGGGTTAGCTTGACAAAGTAGACTTCCTTGTGTTAATTTTTAAGTTTTTTTTTCCTTAACTATA
TCTGTCTACAGGCAGATACAGATAGTTGTATGAAAATCTGCTTGCCTGTAAAATTTGCATTTATAAACGTGTTGCCGATGGATCAC
TTGGGCCTGTACACATACCAATTAGCGTGACCACTTCCATCTTAAAAACAAACCTAAAAAACAAAATTTATTATATATATATATAT
ATATATATAAAGGACTGTGGGTTGTATACAAACTATTGCAAACACTTGTGCAAATCTGTCTTGATATAAAGGAAAAGCAAAATCTG
TATAACATTATTACTACTTGAATGCCTCTGTGACTGATTTTTTTTTTCATTTTAAATATAAACTTTTTTGTGAAAAGTATGCTCA
ATGTTTTTTTTCCCTTTCCCCATTCCCTGTAAATACATTTTGTTCTATGTGACTTGGTTTGGAAATAGTTAACTGGTACTGTAAT
TTGCATTAAATAAAAAGTAGGTTAGCCTGGAAAAAAAAAAAAAAAAAAAA

136 ATTCACATCCTGTGTAATCATAAATACTGCTCTAAGAAAGGGACAGGAAGTCTCAGAGGCTGGAGAGCAGAGCACCAAGATCGTTC
TGGCAGGAACAGCCAGTGGGAGGTTCCAGCTGAGCGCTCCCCAGAGGTGAGCTGATCCCCAGCCACAGCACACAGGACCAGGCTGC
GAGAACAGCATCATCAGCATCATGCTATTACAATCCCAAACCATGGGGGTTTCTCACAGCTTTACACCAAAGGGCATCACTATCCC
TCAAAGAGAGAAACCTGGACACATGTACCAAAACGAAGATTACCTGCAGAACGGGCTGCCAACAGAAACCACCGTTCTTGGGACTG
TCCAGATCCTGTGTTGCCTGTTGATTTCAAGTCTGGGGGCCATCTTGGTTTTTGCTCCCTACCCCTCCCACTTCAATCCAGCAATT
TCCACCACTTTGATGTCTGGGTACCCATTTTTAGGAGCTCTGCTGTGTTTTGGCATTACTGGATTCTCAATTATCTCTGGAAAACA
ATCAAGTAAGCCCTTTGACCTGAGCAGCTTGACCTCAAATGCAGTGAGTTCTGTTACTGCAGGAGCAGGCCTCTTCCTCCTTGCTG
ACAGCATGGTAGCCCTGAGGACTGCCTCTCAACATTGTGGCTCAGAAATGGATTATCTATCCTCATTGCCTTATTCGGAGTACTAT
TATCCAATATATGAAATCAAAGATTGTCTCCTGACCAGTGTCAGTTTAACAGGTGTCCTAGTGGTGATGCTCATCTTCACTGTGCT
GGAGCTCTTATTAGCTGCATACAGTTCTGTCTTTTGGTGGAAACAGCTCTACTTCCAACAACCCTGGGAGTTCATTTTCCTCGACCC
AGTCACAAGATCATATCCAACAGGTCAAAAAGAGTTCTTCACGGTCTTGGATATAAGTAACTCTTGGCCTCAGAGGAAGGAAAAGC
AACTCAACACTCATGGTCAAGTGTGATTAGACTTTCCTGAAATCTCTGCCATTTTAGATACTGTGAAACAAACTAAAAAAAAAAAA
GCTTTTGTTTTGTATTATTTTACTATGAGTCGTTATTTAATTTCTCTTGAAAATAATTTCCTCAAAGCCCAAGTCAATAAATGTTA
TCAGCCAGTCTTCCAAAATGGTCATAAACTTTATAAACTGCTTTGGGTAAACTGAGCAGAAGGTGATACACAGAAGGGAAAATGTG
CACTCATGCTAGTGTGAATTTGGTAAGTTGCGTGACTCTGCAGGCTGTTTCTGTATTATTTTCACACTCATATTGCTTAAATATTA
CATATTAGGGATTGTAAGAAAACTTTAATTAAAAATTAAAGACTATATATAATTAAACTACTCTGCCCTGGACACTCTCTGAGAAA
CAGATCTACTGGGCCCTTTTTCATGAGCCATTAGGTGGAAGACAGCAAAGAGATCTTCTCAAGTGCTTAGGATTACCTCTCAACAC
ACAGCAAGCATGTCCCTGCCTCCCATGAATCTTACCATGTAAATCCAAATCTCTGCAATCCTGTGGCACCAACCAGTGGTGCTCAT
TCTATTGTTTAAAAATGGCCTTCTTGGCTGGGCGCGGTGGCTCACTCCTGTAATCCCAGCACTTTGGTAGGCCGAGGTGGACGGAT
CACCCGAGGTCAGGAGTTTGAGACCAGCCTGGCCAACAAGGTGAAACCCTGTCTCTACTAAAAATACAAAAAATTAGCCAGGCATG
GTGGTGCGCACCTGTAGTTCCAGCTACTTGGGAGGCTGAGGCAGAAGAATCACTTGAACCCGGGAAGGGGAGGTTGCAGTGAGCGG
AGACTGCACCACTGCATTCCAGCCCGGCCTACAAGAACAAAACTCCATCTCAAAATAAATAAAAAAATAAATAAAAATAAAATAG
ACTATATATAGTCTTTGAATTCATTTATTTTAAATAAATGAATAAAATAAAATAAAAAAGAATATTCAGTCGTTGGCACATAAACT
ATGTTCTCTTCTGTCATTTCAGGGTAGGAGTCAATGAAGACATCTTAGTCTTAACAAGTTACAGATAATCTCTGACTGGCATGTTT
TCTGCTTCTAGCTTGGAGCTAAATGCTGCTCATGCTGAAAAGAATAATGTCTATTTCTTTGTTTGGGTATTAGCTCTATTTTGATC
TATAGCACAGTTTTGTAATTCAGATCATCACCCCTGCACTTTGTACCACATGGGCGTATTCTTTCTTCCCAGTCATTGCTGCAATT
ATCTTGTCTGTTCTTTGTGTAATATGTTCTGTGTGAGCCTCTGCATTAAACTCGATTTCTTGGGCAATTATGGAAATTCCAGTGTG
GCTGCAGTTTAACTTTGCACTCTCTATGCATATGAGGTTTCTAAATAAATGAGGAGTAGCATAGTTTAAAATATATATATCTTAT
AACTTTCTACAACAAAGAATTATTGAGTCCAAATGTCATCAGTGCTCATTTTGAGATACCCTGCTATCGATGGTCGCTACAAACCA
GGAAATACTCAAGTTATTATGTGTATACATTGGTTTTAGTTTTATGAAACAATTTACCTTCATGATCTCATAGTTAAAATTGTAAT
AAATTTAGGAATATAAAGGATCAAATATGGGAAGCAAAATTTCTAAGGCAGTTTCTGTTGTTTTAATTAGTATTTGTAGTTCAA
ACCAGGAAGGATTTGACTATCATTAGATTTTGCTTAACTTTATGAAAGCTAAAATATTCTCTGTTATAAAGGGGCAACTCCATCTG
GTCCTATAGCATCTTTACTACTGATTTTTTTTGTTTAATTTGAAAATGCAAAGAATTGTTAAATGTTCTTAAATGTTCTCACTAC
AAAAAAAGAAAAAGATAACTACGTGAGGTGATGGATATGTTAATTAGCTGGATTGTGGTAATCATTTTGGAATGTATATGTATAT
CAAAACATGTAGTACACCCTAAATATATATAATTTTTATTTGTCAAATATACCTCAATAAAGATGGAAAAAAATCGAAATTCAAAA
AAAAAAAAAAAAA

137 TGAATGGCATTGTCACTGCTGGCAGCAGTGTCTTCACAATCCTGCTGCCTTTGCTCTTAAGGGTTCTGATTGACAGCGTGGGCCTC
TTTTACACATTGAGGGTGCTCTGCATCTTCATGTTTGTTCTCTTTCTGGCTGGCTTTACTTACCCAGACCTCTTGCTACCAGTACCAA
AGATAAAGAGAGTGGAGGTAGCGGATCCTCCCTCTTTTCCAGGAAAAGTTCAGTCCTCCAAAAAAATTTTCAATTTGCCATCT
TCAAGGTGACAGCTTATGCAGTGTGGGCAGTTGGAATACCACTTGCACTTTTTGGATACTTTGTGCCTTATGTTCACTTGATGAAA
CATGTAAATGAAAGATTTCAAGATGAAAAAATAAAGAGGTTGTTCTCATGTGCATTGGCGTCACTTCAGGAGTTGGACGACTGCT
CTTTGGCCGGATTGCAGATTATGTGCCTGGTGTGAAGAAGGTTTATCTACAGGTACTCTCCTTTTTCTTCATTGGTCTGATGTCCA
TGATGATTCCTCTGTGTAGCATCTTTGGGGCCCTCATTGCTGTGTGCCTCATCATGGGTCTCTTCGATGGATGCTTCATTTCCATT

TABLE 1-continued

Sequences Table. First column: SEQ ID No. Second column: corresponding mRNA sequence. For the 3 different groups, see explanation in the text.

ATGGCTCCCATAGCCTTTGAGTTAGTTGGTGCCCAGGATGTCTCCCAAGCAATTGGATTTCTGCTCGGATTCATGTCTATACCCAC
GACTGTTGGCCCACCCATTGCAGGGTTACTTCGTGGCAAACTGGGCTCCTATGATGTGGCATTCTACCTCGCTGGAGTCCCTCCCC
TTATTGGAGGTGCTGTGCTTTGTTTTATCCCGTGGATCCATAGTAAGAAGCAAAGAGAGATCAGTAAAACCACTGGAAAAGAAAAG
ATGGAGAAAATGTTGGAAAACCAGAACTCTCTGCTGTCAAGTTCATCTGGAATGTTCAAGAAAGAATCTGACTCTATTATTTAATA
TCTTACATACCTCCACCAGACTGGACTTGCTTTTTGAATTTTAAGCAAGTTTCCTTTCCTTTTATACAAATTGCAAATTTCATATT
TTTTTAATCACATCCTAGGAATAGCACAATAATTGGGAAATAGAACCCTTATCACTAGAAGAACCATTTTCTGCCACTAAATATCT
CTGATGTTTCCATGAGTCTGAGGGCAGAGACTCTGGTATATGAGAACATGTCTGAAAGTCACATATTGTGAAAATTTGAAGCTATC
TCAGTAAAAAGCAGCTTTGGAAACTGTGAATGATCTTTAGCTTGTACAAATGTTTAAAAATACCTCAGGCTATACTGAAAGGGTTG
CAGTTTGGTTAGGAGTGGAAATATTTTGTTTGTTAATGATGTCTTCAGTTCTGGTACCTCTGTTTTACTTTCTTATGCTCTTTGGA
AACTTTTTGCAAAATTTAAGCCTGGGTTCTAGATAATACCAGATCTACCTAAACCTCAAGTCTATGTTAAAGTTGCTTTCCTGCTG
TTAAATAAGCTATGATATTAAGTATTCTGACTTGCTCCAGTGTCAAGGGACCTTCTGGGAGCAGGTGCTAACATAGTGTTCAGAA
TCAATATGTGAGATGAAAAGGATCCCCTCCAGGAGGATCCTGAGCTGTTCAGAAATCATTTAAGTTTACAGCGTTGTTCCCTTTGC
GTTTGCAGTGCGTTTTACTCAAGTAGCCAGAAACACCCCACGTTTCTGAATTTGTTTAAACTGTAACAATAAAGTAAAATAGAATG
CATGAAAGATATTCTGGCGATTGTAACTTAGAATTTTTCTGACTTCTGGATTTGTTGGCACTAGAACCTGATATTTAAAGTCTTAC
TGAGCAGCTATCAAGTGGCAGTTACAGGCACAAATTGGTGGAGGCTGGAGGATGGGGAGGGGAGCAAAACCCTTTATATTTGTGAA
GAAAATATCTGTAGCTGATAGAAATAATTGCTTAAATTGGTTTATGAAATTAATGAGTCTGAAAAGGTTAAAAGCACTTATAAAAA
GAACCAAAGTCCTACATTTCCAGAACTTTCTGGCAAAGATTTGCACTCATATTATTTATCCTATGAACATTCCCATTGTTTTTTTT
TGCTATTTATATACAGATTATCATAAGAAAGCTCTCAGTTTGAGGACCCAAAATAAAACCAAAGTCATGCCATGACCCATACTCAT
TTACAGAAACAAGAACACTTTCCTCTATCCCTAAAATTATGCTTTAGTACTTGAGGCCTTTAAAAGTTAGTGCTTTTGATTGTGAA
GACATTCAGCAACTTACTTTGTCATACATGCAGTTGCACCTTACCACTTCTAATAGTGTCATATTTCATATTCAGGGGACTTAGAT
AATTTGCCTGTGGATGCCTCTTTTGCAGGAAAAAAAATCTATGTTTGACCATACTACCCTTTCATGTCCTTATTATAAGCTTTTAG
AAAATGATTTCATTCAGTCATGTCCAGTTATATAAAACGTTACTTTCTCATTTTTGAGAAGTTCAACAAACATACTACTAAGACCA
TCATCAACCCACTATTATAAATGTTAATTTTGGCTGGGTAAGGTGGCTTGCGCCTATAATCCCAGCACTTTGGGAGGCTGAGGAGG
GAAGATTGCTTGAGCCCAGGAGTTTGAGACCAGCCTGGGCAACATAGCAAGATCCTGTCTCTACTAAGAAAAAAAAAAAAAA

138 TTTTTTTTTTTTTTTTTTACAGCTTCATATACTATTTATTAAGTTATTAATATGAACAGATATGCAACATTACAGATGTCTTTCAA
AGCCTGTAATAAAATATAGTCCACTATCCAGCCCAGGAGAAAGACAACAAACAGTATCATTCTTATAGTAAGTGTAGCATACGTAC
TCACAATAGTTCCCTTATTTGGACATCAAAGGGAACAATCAGTCAAGATTCTTTACCTCCATTAGAATTTAACTTTCTTGGATTAT
AGCTGTTTTAGAGTCAAAAGTCCAACTTAGATTATCCACAGAGATGTGTAGCATCACATGTTGGAGAGGAGGAGATACTGTCACC
TCCGTGGCAGCCCTTTCTACTGTCTTGCAGTCCTTCTATATCGAAGCCCATCTTGCCTTTTAGGCCAGTAGTGGTCAAATTTGGGT
ATGGGGAGAAGGCAGGTGGGTCACAGGGAGGTTTTGATTAATTTACAAAGATTGTGTTTCAAAGCTCTAAAAACCCATTTTGGTGG
TGGCAGTGGCAGTGAAGAGTACACTATATTTCGCCAAGGGGGTCTTCTCATCTCTTGAGTCTTGGCTTTTCATATCCTTTAAAATT
GCTGCAGTTCTCAGTGGGAAAGTGGAGGTGGCAAACTCTAACAGCGATTGGTATGGGGCCATCTGCAGAATGAACTGGACTGGCTA
CTATGGCTTTTATAACCTGCTTTCCTTTCTTTAGTCTAG

139 GCGCACTGGAGCCCTGGCCAGCGCGCAGCCTTCCCGGCGCCGGCGGGCTGGGTCTTGGGAATTCTGGTTTGCTTTGGCTCACTCGC
TTTTTACAAACCACTGGATCTTACATGCCTCTGTACCCCCACTTCCACTCCATGTCCCCATGCTCCTGCGCCAGCAACAGGACAT
GTTCTCTGGATGTCAGCTGAGTCATTAAAGTAACTCTGCATGTCAGTAGACAGACCTTGGTAGAACCACAAGGCTCCCAGAGACAC
CCATCTCTCCTCATTTTTTGGTGTGTGTGTCTTCACCGAACATTCAAAACTGTTTCTCCAAAGCGTTTTGCAAAAACTCAGACTG
TTTTCCAAAGCAGAAGCACTGGAGTCCCCAGCAGAAGCGATGGGCAGTGTGCGAACCAACCGCTACAGCATCGTCTCTTCAGAAGA
AGACGGTATGAAGTTGGCCACCATGGCAGTTGCAAATGGCTTTGGGAACGGGAAGAGTAAAGTCCACACCCGACAACAGTGCAGGA
GCCGCTTTGTGAAGAAAGATGGCCACTGTAATGTTCAGTTCATCAATGTGGGTGGAGAGGGGCAACGGTACCTCGCAGACATCTTC
ACCACGTTGTGTGGACATTCGCTGGCGGTGGATGCTGGTTATCTTCTGCCTGGCTTTCGTCCTGTCATGCTGTTTTTTGGCTGTGT
GTTTTGGTTGATAGCTCTGCTCCATGGGACCTGGATGCATCCAAAGAGGGCAAAGCTTGTGTGTCCGAGGTCAACAGCTTCACGG
CTGCCTTCCTCTTTCTCCATTGAGACCCAGACAACCATAGGCTATGGTTTCAGATGTGTCACGGATGAATGCCCAATTGCTGTTTTC
ATGGTGGTGTTCCAGTCAATCGTGGGCTGCATCATCGATGCTTTCATCATTGGCGGCTGCATGGCCAAGATGGCAAAGCCAAAGAA
GAGAAACGAGACTCTTGTCTTCAGTCACAATGCCGTGATTGCCATGAGAGACGGCAAGCTGTGTTTGATGTGGCGAGTGGGCAATC
TTCGGAAAAGCCACTTGGTGGAAGCTCATGTTCGAGCACAGCTCCTCAAATCCAGAATTACTTCTGAAGGGAGTATATCCCTCTG
GATCAAATAGACATCAATGTTGGGTTTGACAGTGGAATCGATCGTATATTTCTGGTGTCCCAATCACTATAGTCCATGAAATAGA
TGAAGACAGTCCTTTATATGATTTGAGTAAACAGGACATTGACAACGCAGACTTTGAAATCGTGGTCATACTGGAAGGCATGGTGG
AAGCCACTGCCATGACGACACAGTGCCGTAGCTCTTATCTAGCAAATGAAATCCTGTGGGGCCACCGCTATGAGCCTGTGCTCTTT
GAAGAGAAGCACTACTACAAAGTGGACTATTCCAGGTTCCACAAACTTACGAAGTCCCCAACACTCCCCTTTGTAGTGCCAGAGA
CTTAGCAGAAAAGAAATATATCCTCTCAAATGCAAATTCATTTTGCTATGAAAATGAAGTTGCCCTCACAAGCAAAGAGGAAGACG
ACAGTGAAAATGGAGTTCCAGAAAGCACTAGTTACAGGACACGCCCCCTACTAATCCACAACCAGGCAAGTGTACCTCTAGAG
CCCAGGCCCTTACGGCGAGAGTCGGAGATATGACTGACTGATTCCTTCTCTGGAATAGTTACTTTACAACACGGTCTGTTGGTCAG
AGGCCCAAAACAGTTATACAGATGACGGTACTGGTCAAGATGGGTCAAGCAAGCGGCCACAAGGGACTGAGGCAAGCACAATGGTT
TCAAAGAAAGACTGTAAGCTCCATGATTAGCATAAAGCACTAACCATGTCTCCATGTGACCCGATGGCACATAGATGTTGTAGAAT
AAGTTATGGGTTTTTATGTTTTGTTTTGTGTTTTTCCAAAACTTGAACTTGCAGGCAAGCCTTGGTTGGGTATTTGATTTATCCAG
AATGCTTCTCTTTAGGGAACAAGGATGTTTTTAATGGCATAACAAAGGCAAGACTCTGCCTTAATTTTTGAAAAGCTGCTAACTAC
ATGAACACAAATGTGTATTTTTGTTGCAGTGTAGTTTTCCTTTTGTGTAATTTTAAAGTCAGTGTTGAATTTTATTGAAAGCTCAT
GATGCGCTTCAAAGTGGCAAGTATTTGGCTATTAACTGCCAAAACAAGAGCCTGATTTTTGAGGCCAGTAATTCGTTTGCTAGAA
TTGATTTTTTTCTCTCTCTTTGTTACATAAGGGCATTATGTAACACTAGCCGAATGGTAGCCTCTGGGTTGTTGTTTTTTCT
TTTCCTCCATGATGTTAATGGGTTATCTCAAATTTTAAGTTAACTAAAATAATACAAAGATAATGCATATTTTTGCACA
GTGGAGCTTACACTTAAAAGAAAACAAAGCCCCATGGGCTGCCTTGAAATCAAGAGACAATAACTTTGAACCTCAGCAAGACCTTG
AACCGCCGGTTCATTTTGCACCTTATTCAGAAAATAGAGCATCATACTCACCGAGTCTAGTCAGTGTAGTGCTTTTAAAATTTTG
TCCTTTCATGTAACTTTTTATTTTAAGAGGAAGAAGAAGAAAGGGGCACACACACAATACCGACGTCTATCCTTTCCTGCTAG
GCAGTGCTGGCCAGGCTCATGTGTAGTGTGCGAGATGGTGATGTACTCTTATATTTTCTGGGCTTTTCCTTTTGCACATTCCAAA
ATTCATTTCATAAGACAAGATCTTCATAGGACCTCCTTGGCATCCTGGCATTCTCAAAACTGAGCCATCCAGCATGAAAGATAAAT
GGGTTTAAACCCTTGCTGCTGAATTTATTGCCTGGACTGTCAGGACATCACCAGCCCACCTTCACCTTAGGGAAGATGCCACACCT
GGCCTCCACACTTGCTCTTCTGATCAGTCTGTCTGGATTGAGTCCTACAGTGTCAGATAGGGCGGCAAATGCCAAAGCAGGGAAAC
AGGGAGGTGTGGACAAGCCAGTTTGATGCAGCACTTCAGATCAAGTGCTTAGGAAGGAGAAGACATTGCCTTTTTTATGGCAGA
GATAGTAATGAAAATGTCTCAGTATTTTAGGGTCAATGAGAGCCATAAAAATATAACATAATCACAAGTAAAGGAGATAATGGTCT
AAAACAGCTATTTCCCTTTTCTGTGTGCATACTTATGACTGAATGTGAGCTAAGCATTTTCTCCTGTGGAGCCCTAGAGCAGGTTA
CTAAGGAAGGACACATTGTTTTCCAGAAGCCTCCCCTGCCTGGCTGACTGCCTTGCTAGAAACATAATTTTTTTTTTCTCACTGAA
GCTCAATAATGGAACTCTTTTTTTTTTTTTTTAATTTAAAGTTCCCTATTTGTGAATTCTGGGATTACTGACTTTTCTTTTTAA
TTGGAGTCTCAAAATCAACTCTCTTATGGTATTATATCTCTGTATGCCATTAAAAAACAGCTTGTTCTAGAATCATGTATTTTGTA

TABLE 1-continued

Sequences Table. First column: SEQ ID No. Second column: corresponding mRNA sequence. For the 3 different groups, see explanation in the text.

```
      AACTGATGTTTGTGATGGTCTCTGGTTCTTGAACAGCCATATCTGAATGCCGTGCCTGCAAAACTATGACAATTTTTGCTGTTTTC
      AGCCTTCAGATTTGATGGCTTGGGAAACTGAGGTGTTATTTTCAATGAAACAAAGAAAGAGATGTTAAGCAAGTGGTTGTTTTAGA
      TCCAAATGTAAAGGCAGGTTTGGGAAGGTGTTTAAAGAGTTGGAGGAATTGGGGATTGAGTTGTAAAGAAAACTTACAGAAGAGGC
      AACAATTTGGTTCTTGACAGTGAGAGGATATTGAGGGCTTCAGCTGCTGCTATTATGATGTTTGCAAAGGAAAATAATCAAACCA
      AAGAGTATTCAGTGATATGTAAATTAAATGAAGATACAGTGGAGAATGGGGGTGACCACAAAAGAGGCTCCCCCTAAACACACAGT
      GCTGCCACTTAAAAAGACTTGAGAAATTTGAAAGGGGGTGGGTATGGGGGGGGCAAGAAAGAGGGAGGGAAATCTTTCAACTTATT
      TCTGAAAAAGAGAAAAAAATATAAAATTTCTGGTGCACAGGTTTGTTTTTTCAAGAAAATTTTGCAGAAGCTATGTTTTTAAAGTG
      TACATTTTATAAAGTTTATCAGATATTTTTCATATTTAAAGCCAAATGTAAATAGAGGTCTGTAAAGAAAAATAATTGCCATAGAAA
      GTATAATTTCAGTGCAGTAATTTCTGAGAGCTAGTACCTATATGCTACCGGTTAGCATGGTTTTAGCAAATATATACCAGCCTTAT
      AAGGTTCGTATTGCTATGTTCTTCTGTTATTTATTTCAGCATGGACTGTTCATTTGAAACCTTTTTCTAGTTATTAGCGTTTTAAC
      AGTTACAAGCTTTAAATGGCAATTTTTTTTTTTTTTTTTTTTTTTTTTTTGTCAAGAGCCAAGACACAGGTAATGCACGA
      CATTGATTGCTGCATTTTACCTTCAAAATATTTGTCCTTATTGACTGGGTCTCCTTAATTAATGTACACATGTCATTAGAATGCAG
      ACGGAGGGGACTCACCATGAATATCTGGGGTTGATTCCCAGATGTGTTGCTTCTCTATTGCAAGCAGATTCCCTGTTGGATTTA
      CTTCGGATTTATTCCCTTTTAAAGAATTTTTGCCCATATCTGGAAGGGCACTATATTTTGGGAGGAGCCATAGATTCCTGGTTAT
      CCTATTTTTAAACAAAATGTAGACAAAGTGAACTCTATTTTGATTATTGAGAAAGGAGTAGTTTTCTATCCCTCTAAGAGTATACT
      TGAATCAGACATTTTAAGGATGTCACTATGGCACTGTTGTCATTTCCAAATTCCTAGAAAAGTTTGTTTTACTTTGTTTTTATTCT
      GTTAATGCATTCTTTCTTCTCTTTACTTCCTTTCTTACCAGTACACTCCTATCTCAACTCTGTTTATTTGATGAGTTCTGTCCCGT
      AAATCATATTTCCCTTACAATTAATAAATGTCACTTCATATTTTATAATAAACCACTCAGTAAAAGCAAAAGCTTGTCCTGAGAAG
      TAGAGTGAGTTCTTTTTCACTCTGTGTCTAATAATGTTAAGGTGGGAAAAAAAAAAGTGTGGCATAGCTACCTGCCCATCCCCAAC
      CCTCAGCAAAGTAGAATCTCTTTTCTGGTAATTTTGGGTTTCCGCTCTGGGCTCTGGCAAGTTGAACAATCCTAGCCATTGACAAT
      CGTGATAGTTATTATTTTCCCATTTGCTGTCTTTTTGTATCTAAAGTCTTCCTATTGTACTGCACAAACCATGGATTGTACATATT
      TTTATATATTATGTCTTATTTTATTATTTCTAAATAAAAAAATTAAAAATTGAAAAAAAAAAAAAAA

140   AAGCACCTAATTTATCCAGTAACCAACAACCCTAACCATTGGCATATATAGTCTTTCACTCAGAAATAAACAAAAACTGTTTGGTA
      TATCTGTATCATTGCTAATCTTGTGCACTTTACTTTTTGGGCAGTACCATACATAGTCTGAGGCTATTCGACTTAAACCAATAACT
      GTACTTTATGTAATGACTCTTAAATTTGGTTACCTGGGTTCACAGCTTGCTTGAAGAGAAAGGATGCTAGAATAAAGTAAGCAGCT
      GAAGAGCGAGCAAATCAAGACAAAACACAGTGGTCTCAGATTTTTCCGTAGTGTGGGAACAGTGGTTTTGCTCTATACCACTGAAA
      AGCACTATAACATAATTGTTGTCCATGACTGAAGCTTTTCCCCTCACTTCTAGGTTGGTTTACATTCAGAGCTCCTATCAATAA
      AGAGGGAATACATATTACAGTGGAANTCCGACAACCGGCACNAGTTGGGCAGTAAGGTATCCCCCACCTAATTTATCCTGGGTAAA
      TCACCCNGGTTCCCAAGTGCTGCNGGGATAAAGAGTGGTTACCTTTTAATGCNCCTAGACAGGGTAGT

141   AATATCAACCTGTTTCCTCCTCCTCCTTCTCCTCCTCCTCCGTGACCTCCTCCTCCTCTTTCTCCTGAGAAACTTCGCCCCAGCGG
      TGCCGGAGCGCCGCTGCGCAGCCGGGGAGGGACGCAGGCAGGCGGCGGCGGCGCAGCGGGAGGCGGCAGCCCGGTGCGGTCCCCGCGGCTC
      TCGGCGGAGCCCCGCGCCCGCCGCGCCCATGGCCCGAAGACCCCGGCACAGCATATATAGCAGTGACGAGGATGATGAGGACTTTGA
      GATGTGTGACCATGACTATGATGGGCTGCTTCCCAAGTCTGGAAAGCGTCACTTGGGGAAAACAAGGTGGACCCGGGAAGAGGATG
      AAAAACTGAAGAAGCTGGTGGAACAGAATGGAACAGATGACTGGAAAGTTATTGCCAATTATCTCCCGAATCGAACAGATGTGCAG
      TGCCAGCACCGATGGCAGAAAGTACTAAACCCTGAGCTCATCAAGGGTCCTTGGACCAAAGAAGAAGATCAGAGAGTGATAGAGCT
      TGTACAGAAAATACGGTCCGAAACGTTGGTCTGTTATTGCCAAGCACTTAAAGGGGAGAATTGGAAACATGTAGGGAGGGTGGC
      ATAACCACTTGAATCCAGAAGTTAAGAAAACCTCCTGGACAGAAGAGGAAGACAGAATTATTTACCAGGCACACAAGAGACTGGGG
      AACAGATGGGAGAAATCGCAAAGCTACTGCCTGGACGAACTGATAATGCTATCAAGAACCACTGGAATTCTACAATGCGTCGGAA
      GGTCGAACAGGAAGGTTATCTGCAGGAGTCTTCAAAAGCCAGCCAGCCAGCAGTGGCCACAAGCTTCCAGAAGAACAGTCATTTGA
      TGGGTTTTGCTCAGGCTCCGCCTACAGCTCAACTCCCTGCCACTGGCCAGCCCACTGTTAACAACGACTATTCCTATTACCACATT
      TCTGAAGCAGAAAATGTCTCCAGTCATGTTCCATACCCTGTAGCGTTACATGTAAATATAGTCAATGTCCCTCAGCCAGCTGCCGC
      AGCCATTCAGAGACACTATAATGATGAAGACCCTGAGAAGGAAAAGCGAATAAAGGAATTAGAATTGCTCCTAATGTCAACCGAGA
      ATGAGCTAAAGGACAGCAGGTGCTACCAACACAGAACCACACATGCAGCTACCCCGGGTGGCACAGCACCACCATTGCCGACCAC
      ACCAGACCTCATGGAGACAGTGCACCTGTTTCCTGTTTGGGAGAACACCACTCCACTCCATCTCTGCCAGCGGATCCTGGCTCCCT
      ACCTGAAGAAGCGCCTCGCCAGCAAGGTGCATGATCGTCCACCAGGGCACCATTCTGGATAATGTTAAGAACCTCTTAGAATTTG
      CAGAAACACTCCAATTTATAGATTCTGATTCTTCATCATGGTGTGATCTCAGCAGTTTTGAATTCTTTGAAGAAGCAGATTTTTCA
      CCTAGCCAACATCACACAGGCAAAGCCCTACAGCTTCAGCAAAGAGAGGGCAATGGGACTAAACCTGCAGGAGAACCTAGCCCAAG
      GGTGAACAAACGTATGTTGAGTGAGAGTTCACTTGACCCACCCAAGGTCTTACCTCCTGCAAGGCACAGCACAATTCCACTGGTCA
      TCCTTCGAAAAAAACGGGGCCAGGCCAGCCCCTTAGCCACTGGAGACTGTAGCTCCTTCATATTTGCTGACGTCAGCAGTTCAACT
      CCCAAGCGTTCCCCTGTCAAAAGCCTACCCTTCTCTCCCTCGCAGTTCTTAAACACTTCCAGTAACCATGAAAACTCAGACTTGGA
      AATGCCTTCTTTAACTTCCACCCCCCTCATTGGTCACAAATTGACTTTGACACACCATTTCATAGAGACCAGACTGTGAAAACTC
      AAAAGGAAAATACTGTTTTTAGAACCCCAGCTATCAAAAGGTCAATCTTAGAAAGCTCTCCAAGAACTCCTACACCATTCAAACAT
      GCACTTGCAGCTCAAGAAATTAAATACGGTCCCCTGAAGATGCTACCTCAGACACCCTCTCATCTAGTAGAAGATCTGCAGGATGT
      GATCAAACAGGAATCTGATGAATCTGGAATTGTTGCTCAGTTTCAAGAAAATGGACCACCCTTACTGAAGAAAATCAAACAAGAGG
      TGGAATCTCCAACTGATAAATCAGGAAACTTCTTCTGCTCACACCACTGGGAAGGGGACAGTCTGAATACCCAACTGTTCACGCAG
      ACCTCGCCTGTGGCAGATGCCACCGAATATTCTTACAAGCTCCGTTTAAGCAGCATCAGAAGATCAGAAGATGAAGACAATGTTCTCAA
      AGCATTTACAGTACCTAAAAACAGGTCCCTGGCGAGCCCCTTGCAGCCTTGTAGCAGTACCTGGGAACCTGCATCCTGTGGAAAGA
      TGGAGGAGCAGATGACATCTTCCAGTCAAGCTCGTAAATACGTGAATGCATTCTCAGCCCGGACGCTGGTCATGTGAGACATTTCC
      AGAAAAGCATTATGGTTTTCAGAACACTTCAAGTTGACTTGGGATATATCATTCCTCAACATGAAACTTTTCATGAATGGGAGAAG
      AACCTATTTTTGTTGTGGTACAACAGTTGAGAGCAGCACCAAGTGCATTTAGTTGAATGAAGTCTTCTTGGATTTCACCCAACTAA
      AAGGATTTTTAAAAATAAATAACAGTCTTACCTAAATTATTAGGTAATGATAAGTGTAGCCAGTTGTTAATATCTTAATGCAGATTTT
      TTTAAAAAAAACATAAAATGATTTATCTGTATTTTAAAGGATCCAACAGATCAGTATTTTTCCTGTGATGGGTTTTTGAAATTT
      GACACATTAAAAGGTACTCCAGTATTTCACTTTTCTCGATCACTAAACATATGCATATATTTTTAAAAATCAGTAAAAGCATTACT
      CTAAGTGTAGACTTAATACCATGTGACATTTAATCCAGATTGTAAATGCTCATTTATGGTTAATGACATTGAAGGTACATTTATTG
      TACCAAACCATTTTATGAGTTTTCTGTTAGCTTGCTTTAAAAATTATTACTGTAAGAAATAGTTTTATAAAAAATTATATTTTAT
      TCAGTAATTTAATTTTGTAAATGCCAAATGAAAAACGTTTTTTGCTGCTATGGTCTTAGCCTGTAGACATGCTGCTAGTATCAGAG
      GGGCAGTAGAGCTTGGACAGAAAGAAAAGAAACTTGGTGTTAGGTAATTGACTATGCACTAGTATTTCAGACTTTTTAATTTTATA
      TATATATACATTTTTTTTCCTTCTGCAATACATTTGAAAACTTGTTTGGGAGACTCTGCATTTTTTATTGTGGTTTTTTGTTATT
      GTTGGTTTATACAAGCATGCGTTGCACTTCTTTTTTGGGAGATGTGTGTTGTTGATGTTCTATGTTTTGTTTTGAGTGTAGCCTGA
      CTGTTTTATAATTTGGGAGTTCTGCATTTTGATCCGCATCCCCTGTGGTTTCTAAGTGTATGGTCTCAGAACTGTTGCATGGATCCT
      GTGTTTGCAACTGGGGAGACAGAAACTGTGGTTGATAGCCAGTCACTGCCTTAAGAACATTTGATGCAAGATGGCCAGCACTGAAC
      TTTTGAGATATGACGGTGTACTTACTGCCTTGTAGCAAAATAAAGATGTGCCCTTATTTT
```

TABLE 1-continued

Sequences Table. First column: SEQ ID No. Second column: corresponding mRNA sequence. For the 3 different groups, see explanation in the text.

142 GCAGAGGGAGCGAGCGGGCGGCCGGCTAGGGTGGAAGAGCCGGGCGAGCAGAGCTGCGCTGCGGGCGTCCTGGGAAGGGAGATCCG
GAGCGAATAGGGGGCTTCGCCTCTGGCCCAGCCCTCCCGCTGATCCCCCAGCCAGCGGTCCGCAACCCTTGCCGCATCCACGAAAC
TTTGCCCATAGCAGCGGGCGGGCACTTTGCACTGGAACTTACAACACCCGAGCAAGGACGGACTCTCCCGACGCGGGGAGGCTAT
TCTGCCCATTTGGGGACACTTCCCCGCCGCTGCCAGGACCCGCTTCTCTGAAAGGCTCTCCTTGCAGCTGCTTAGACGCTGGATTT
TTTTCGGGTAGTGGAAAACCAGCAGCCTCCCGCGACGATGCCCCTCAACGTTAGCTTCACCAACAGGAACTATGACCTCGACTACG
ACTCGGTGCAGCCGTATTTCTACTGCGACGAGGAGGAGAACTTCTACCAGCAGCAGCAGCAGAGCGAGCTGCAGCCCCCGGCGCCC
AGCGAGGATATCTGGAAGAAATTCGAGCTGCTGCCCACCCCGCCCCTGTCCCCTAGCCGCCGCTCCGGGCTCTGCTCGCCCTCCTA
CGTTGCGGTCACACCCTTCTCCCTTCGGGGAGACAACGACGGCGGTGCAGCGGACTTCTCCACGGCCGACCAGCTGGAGATGGTGA
CCGAGCTGCTGGGAGGAGACATGGTGAACCAGAGTTTCATCTGCGACCCGGACGACGAGACCTTCATCAAAAACATCATCATCCAG
GACTGTATGTGGAGCGGCTTCTCGGCCGCCGCCAAGCTCGTCTCAGAGAAGCTGGCCTCCTACCAGGCTGCGCGCAAAGACAGCGG
CAGCCCGAACCCCGCCCGCGGCCACAGCGTCTGCTCCACCTCCAGCTTGTACCTGCAGGATCGAGCGCCGCCGCCTCAGAGTGCA
TCGACCCCTCGGTGGTCTTCCCCTACCCTCTCAACGACAGCAGCTGCCCAAGTCCTGCGCCTCGCAAGACTCCAGCGCCTTCTCT
CCGTCCTCGGATTCTCTGCTCTCCTCGACGGAGTCCTCCCCGCAGGGCAGCCCCGAGCCCCTGGTGCTCCATGAGGAGACACCGCC
CACCACCAGCAGCGACTCTGAGGAGGAACAAGAAGATGAGGAAGAAATCGATGTTGTTTCTGTGGAAAAGAGGCAGGCTCCTGGCA
AAAGGTCAGAGTCTGGATCACCTTCTGCTGGAGGCCACAGCAAACCTCCTCACAGCCCACTGGTCCTCAAGAGGTGCCACGTCTCC
ACACATCAGCACAACTACGCAGCGCCTCCCTCCACTCGGAAGGACTATCCTGCTGCCAAGAGGGTCAAGTTGGACAGTGTCAGAGT
CCTGAGACAGATCAGCAACAACCGAAAATGCACCAGCCCCAGGTCCTCGGACACCGAGGAGAATGTCAAGAGGCGAACACACAACG
TCTTGGAGCGCCAGAGGAGGAACGAGCTAAAACGGAGCTTTTTTGCCCTGCGTGACCAGATCCCGGAGTTGGAAAACAATGAAAAG
GCCCCCAAGGTAGTTATCCTTAAAAAAGCCACAGCATACATCCTGTCCGTCCAAGCAGAGGAGCAAAAGCTCATTTCTGAAGAGGA
CTTGTTGCGGAAACGACGAGAACAGTTGAAACACAACTTGAACAGCTACAGAGCTCTTGTGCGTAAGGAAAAGTAAGGAAAACGA
TTCCTTCTAACAGAAATGTCCTGAGCAATCACCTATGAACTTGTTTCAAATGCATGATCAAATGCAACCTCACAACCTTGGCTGAG
TCTTGAGACTGAAAGATTTAGCCATAATGTAAACTGCCTCAAATTGGACTTTGGGCATAAAAGAACTTTTTTATGCTTACCATCTT
TTTTTTTCTTTAACAGATTTGTATTTAAGAATTGTTTTTAAAAAATTTTAAGATTTACACAATGTTTCTCTGTAAATATTGCCAT
TAAATGTAAATAACTTTAATAAAACGTTTATAGCAGTTACACAGAATTTCAATCCTAGTATATAGTACCTAGTATTATAGGTACTA
TAAACCCTAATTTTTTTATTTAAGTACATTTTGCTTTTTAAAGTTGATTTTTTCTATTGTTTTTAGAAAAAATAAAATAACTGG
CAAATATATCATTGAGCCAAAAAAAAAAAAAAAAAAAAAA

143 CACAGAGCCCGGGCCGCAGGCACCTCCTCGCCAGCTCTTCCGCTCCTCTCACAGCCGCCAGACCCGCCTGCTGAGCCCCATGGCCC
GCGCTGCTCTCTCCGCCGCCCCAGCAATCCCCGGCTCCTGCGAGTGGCACTGCTGCTCCTGCTCCTGGTAGCCGCTGGCCGGCGC
GCAGCAGGAGCGTCCGTGGCCACTGAACTGCGCTGCCAGTGCTTGCAGATCCTGCAGGGAATTCACCCCAAGAACATCCAAAGTGT
GAACTTGAAGTCCCCCGGACCCCACTGCGCCCAAACCGAAGTCATAGCCACACTCAAGAATGGGCGGAAAGCTTGCCTCAATCCTG
CATCCCCCATAGTTAAGAAAATCATCGAAAAGATGCTGAACAGTGACAAATCCAACTGACCAGAAGGGAGGAGGAAGCTCACTGGT
GGCTGTTCCTGAAGGAGGCCCTGCCCTTATAGGAACAGAAGAGGAAAGAGAGACACAGCTGCAGAGGCCACCTGGATTGTGCCTAA
TGTGTTTGAGCATCGCTTAGGAGAAGTCTTCTATTTATTTATTTATTCATTAGTTTTGAAGATTCTATGTTAATATTTTAGGTGTA
AAATAATTAAGGGTATGATTAACTCTACCTGCACACTGTCCTATTATATTCATTCTTTTTGAAATGTCAACCCCAAGTTAGTTCAA
TCTGGATTCATATTTAATTTGAAGGTAGAATGTTTTCAAATGTTCTCCAGTCATTATGTTAATATTTCTGAGGAGCCTGCAACATG
CCAGCCACTGTGATAGAGGCTGGCGGATCCAAGCAAATGGCCAATGAGATCATTGTGAAGGCAGGGGAATGTATGTGCACATCTGT
TTTGTAACTGTTTAGATGAATGTCAGTTGTTATTTATTGAAATGATTTCACAGTGTGTGGTCAACATTTCTCATGTTGAAACTTTA
AGAACTAAAATGTTCTAAATATCCCTTGGACATTTTATGTCTTTCTTGTAAGGCATACTGCCTTGTTTAATGGTAGTTTTACAGTG
TTTCTGGCTTAGAACAAAGGGGCTTAATTATTGATGTTTTCATAGAGAATATAAAAATAAAGCACTTATAG

144 AAGGACACGGGCAGCAGACAGTGGTCAGTCCTTTCTTGGCTCTGCTGACACTCGAGCCCACATTCCGTCACCTGCTCAGAATCATG
CAGGTCTCCACTGCTGCCCTTGCTGTCCTCCTCTGCACCATGGCTCTCTGCAACCAGTTCTCTGCATCACTTGCTGCTGACACGCC
GACCGCCTGCTGCTTCAGCTACACCTCCCGGCAGATTCCACAGAATTTCATAGCTGACTACTTTGAGACGAGCAGCCAGTGCTCCA
AGCCCGGTGTCATCTTCCTAACCAAGCGAAGCCGGCAGCCTGTGCTGACCCCAGTGAGGAGGTGGGTCCAGAAATATGTCAGCGAC
CTAGAGCTGAGTGCCTGAGGGGTCCAGAAGCTTCGAGGCCCAGCGACCTCGGTGGGCCAGTGGGGAGGAGCAGGAGCCTGAGCCTT
GGGAAACATGCGTGTGACCTCCACAGCTACCTCTTCTATGGACTGGTTGTTGCCAAACAGCCACACTGTGGGACTCTTCTTAACTT
AAATTTTAATTTATTTATACTATTTAGTTTTTGTAATTTATTTTCGATTTCACAGTGTGTTTGTGATTGTTTGCTCTGAGAGTTCC
CCTGTCCCCTCCCCCTTCCCTCACACCGCGTCTGGTGACAACCGAGTGGCTGTCATCAGCCTGTGTAGGCAGTCATGGCACCAAAG
CCACCAGACTGACAAATGTGTATCGGATGCTTTTGTTCAGGGCTGTGATCGGCCTGGGGAAATAATAAAGCACGCTCTTTTAAAAG
GT

145 ATAAAAACCCAGAAAGCCCCAGAAACAAAGACTTCACGGACAAAGTCCCTTGGAACCAGAGAGAAGCCGGGATGGAAACTCCAAAC
ACCACAGAGGACTATGACACGACCACAGAGTTTGACTATGGGGATGCAACTCCGTGCCAGAAGGTGAACGAGAGGGCCTTTGGGGC
CCAACTGCTGCCCCCTCTGTACTCCTTGGTATTTGTCATTGGCCTGGTTGGAAACATCCTGGTGGTCCTGGTCCTTGTGCAATACA
AGAGGCTAAAAAACATGACCAGCATCTACCTCCTGAACCTGGCCATTTCTGACCTGCTCTTCCTGTTCACGCTTCCCTTCTGGATC
GACTACAAGTTGAAGGATGACTGGGTTTTTGGTGATGCCATGTGTAAGATCCTCTCTGGGTTTTATTACACAGGCTTGTACAGCGA
GATCTTTTTCATCATCCTGCTGACGATTGACAGGTACCTGGCCATCGTCCACGCCGTGTTTGCCTTGCGGGCACGGACCGTCACTT
TTGGTGTCATCACCAGCATCATCATTTGGGCCCTGGCCATCTTGGCTTCCATGCCAGGCTTATACTTTTCCAAGACCCAATGGGAA
TTCACTCACCACACCTGCAGCCTTCACTTTCCTCACGAAAGCCTACGAGAGTGGAAGCTGTTTCAGGGCTCTGAAACTGAACCTCTT
TGGGCTGGTATTGCCTTTGTTGGTCATGATCATCTGCTACACAGGGATTATAAAGATTCTGCTAAGACGACCAAATGAGAAGAAAT
CCAAAGCTGCGTTTGATTTTTGTCATCATGATCATCTTTTTTCTCTTTTGGACCCCCTACAATTTGACTATACTTATTTCTGTT
TTCCAAGACTTCCTGTTCACCCATGAGTGTGAGCAGAGCAGACATTTGGACCTGGCTGTGCAAGTGACGGAGGTGATCGCCTACAC
GCACTGCTGTGTCAACCCAGTGATCTACGCCTTCGTTGGTGAGAGGTTCCGGAAGTACCTGCGGCAGTTGTTCCACAGGCGTGTGG
CTGTGCACCTGGTTAAATGGCTCCCCTTCCTCTCCGTGGACAGGCTGGAGAGGGTCAGCTCCACATCTCCCTCCACAGGGGAGCAT
GAACTCTCTGCTGGGTTCTGACTCAGACCATAGGAGGCCAACCCAAAATAGCCAGTAGTGGTGACCTCCTGCTCCAGTGCTCAGCAG
CCTGGCTCTCCCAGCCAGGTTCTGACTCTTGGCACAGCATGGAGTCACAGCCACTTGGGATAGAGAGGGAATGTAATGGTGGCCTG
GGGCTTCTGAGGCTTCTGGGGCTTCAGTCTTTTCCATGAACTTCTCCCCTGGTAGAAAGAAGATGAATGAGCAAACCAAATATTC
CAGAGACTGGGACTAAGTGTACCAGAGAAGGGCTTGGACTCAAGCAAGATTTCAGATTTGTGACCATTAGCATTTGTCAACAAAGT
CACCCACTTCCCACTATTGCTTGCACAAACCAATTAAACCCAGTAGTGGTGACTGTGGGCTCCATTCAAAGTGAGCTCCTAAGCCA
TGGGAGACACTGATGTATGAGGAATTTCTGTTCTTCCATCACCTCCCCCCCCCCGCCACCCTCCCACTGCCAAAGAACTTGGAAAT
AGTGATTTCCACAGTGACTCCACTCTGAGTCCCAGAGCCAATCAGTAGCCAGCATCTGCCTCCCTTCACTCCCACCGCAGGATTT
GGGCTCTTGGAATCCTGGGGAACATAGAACTCATGACGGAAGAGTTGAGACCTAACGAGAAATAGAAATGGGGAACTACTGCTGGC
AGTGGAACTAAGAAAGCCCTTAGGAAGAATCTTTATATCCACTAAAATCAAACAATTCAGGGAGTGGGCTAAGCACGGGCCATATG
AATAACATGGTGTGCTTCTTAAAATAGCCATAAAGGGGAGGGACTCATCATTTCCATTTACCCTTCTTTTCTGACTATTTTTCAGA

TABLE 1-continued

Sequences Table. First column: SEQ ID No. Second column: corresponding mRNA sequence. For the 3 different groups, see explanation in the text.

```
    ATCTCTCTTCTTTTCAAGTTGGGTGATATGTTGGTAGATTCTAATGGCTTTATTGCAGCGATTAATAACAGGCAAAAGGAAGCAGG
    GTTGGTTTCCCTTCTTTTTGTTCTTCATCTAAGCCTTCTGGTTTTATGGGTCAGAGTTCCGACTGCCATCTTGGACTTGTCAGCAA
    AAAAAAAAAATAATAATAATAATAAGGCCTGCTGTGTAAGCTGACAGTATTTGTAGCTGATAGGGGGTTGGGAGGAAAGTGTCTAC
    TAGGAGGGTGGGGTGAGATTCTGTGTTGATGTAGGAGGCCGGAAGGACCCTTAACTCAAAGTAGCTTATTTATCCAAAATGTTCTG
    GATGCATCATCTCCAACCAAGGACCCCTTATTTATCATGCCTTTGTTCTCTTTTCCCTCAGATGTATATTTCTTTAAAAATAATTT
    TCCTAATAACAAAACTTATTTCTAAAACAGCTTAAAAATTCAAAGAAAAACCCCAAACACTGACATTACCTACACTTCCACTACCC
    AAAGACAAAATGTGCCCACTGTGTGCTTTTGAGTGTATTTTCTTTTAGTTTGTTTTTTGTTGGGTGCATATTTATGATAATAACAA
    TGATGGACTTCAATTGTACTCACTGTTCTATTGTTGGTTTTAATTAGCAGCAAGTTGTGATCACTTTCCCAGGTGAATAAATCATT
    TCAAAGCATTAAAAAAAAAAAAAA

146 AAACCCAAAGCGGCCGCCGTAGGCGAAGGTGAAGATGGCTGCCTCTGCCTTTGCTGGTGCAGTGAGAGCAGCTTCAGGAATCCTAC
    GGCCCCTGAATATTTTGGCATCTTCAACCTACCGCAACTGTGTCAAGAATGCCTCTCTTATTTCTGCATTGTCCACTGGACGTTTT
    AGTCATATTCAGACACCAGTTGTTTCCTCCACTCCCAGACTTACCACATCTGAGAGAAACCTGACATGTGGGCATACCTCAGTGAT
    CCTTAATAGAATGGCCCCCGTGCTTCCAAGTGTCCTGAAGCTGCCAGTCAGATCTCTAACATACTTCAGTGCAAGAAAAGGCAAGA
    GAAAGACCGTGAAAGCTGTCATCGATAGGTTTCTTCGACTTCATTGTGGCCTTTGGGTGAGGAGAAAGGCTGGCTATAAGAAAAAA
    TTATGGAAAAAGACACCTGCAAGGAAGAAGCGATTGAGGGAATTTGTATTCTGCAATAAAACCCAGAGTAAACTCTTAGATAAAAT
    GACGACGTCCTTCTGGAAGAGGCGAAACTGGTACGTTGATGATCCTTATCAGAAGTATCATGATCGAACAAACCTGAAAGTATAGA
    TCAGAAGTTTCACTTGTTTCTCAGTTATTGGATATGTATCTTTGTACATATCTTTGCAAAAATGGATAAGTACAAAACTTGATG
    TAAATTGTACCAATGAATACGTAAACATACAGTGACAACATTAAACTTAGAAAAGTTTTAAACTTAATGGATCAGACTTTGCCAG
    ATTTGGTTAGGGAAACAGAAATTTAGAATGGTGCATTATTTTTAACAAATGGTATTGGCTTAACTAGTTGTTTCAGTTATGCTCTT
    TTAGTTGCAAGGAATCTCAAGTGGGACAAACATAAAAAGACTCAAAAGCTACAAGTTAGCTCAAGCAATGTGACATTATTTCAAGG
    ATATGTGCCAGGGAATTCAGGAACCACCTCACCAACCCCATCTCCCACTCAGAAATCACCTCCCAGCCTCAGGAAGAGTAGAAATT
    GGGTGGTGCTCCTCAGCAGGGGAAGGTGGATGTTTAGGCTTGGGCTCTGCATGCATGTGACTTGCTTCTTTTTGCATTGTTAACTC
    CATTCTCTCTATTCACCAACTTCTCTACACAGCTTTTGCATACTTACAGTTTCTGTTCCTTTGTAATAACTTTAACTTGCACCTTT
    GAGGTTCTTTTCTACATGATGACCTTCAGCTCCTGCTGCTGCTTGCTCCAATTGCCAAGGGAATTTAACTGGGCCAGACTACCTTTTT
    ATACTAGGTCTGGTTGGGTCATTGTCTAGAGTAGGGATTGGCTGTCCTTAAGTCAGGAGCCCGCTTTGTATTAGCAGGTTTGCATG
    CAGCAAAAAAACAGTTATGTGAGCAGTTTCACTTGGAGGTTCACATGGGGTGGCAGCACACTTAACATCTAACACACCAGGTTCAT
    TGTGTTCATAACACTTGTCATTTACTGTAACAACATTTTTTCATAGGAGAGTAAATAGCCCTTCAGCATGCTCATTCATGAAACAG
    AAGAGGCTGTACAAGTGAAGACAAGGGCTTTTTATGCAAGTTTTGAAAGATAGGTATTTATTTTTTCTAGAGACAGGAGTTTTGCT
    CTGTTGCCCAGGCTGGAGTGCAGTGGTGCAATCATAGCTCATTGAAGCCTCGCACTCCTGGGCTCAAGTGGTCCTCCTGCCTCAGC
    TTACTGAGTAAGGATATGTATTTCTTAAAAGTTAGTTTATCCACTTCAGATTTCATGTTTTCATTTGTAAGGATAAACTTTTCCCA
    CAAATTTTCAACAATCATTGTAGAAACTAAGGGGGAGAAAGTAATCTCAGTTGTTTTAGAAACGAAAAAGTTAAGCATTGTTTACT
    TGAAGTGGGCAGGGAAGCAGCACTGAGTAAAGTTCAATTGAGTGGTTACAGTCTAGGGCAGTGGTTCCCAACTCTCCGATCAGAAT
    CATCTGGGAAGCATTTTCAAACAGCAAAGTACTTTGAAAACCATTATTAAATAGAATTATGCATGAATTACTGTTTCAGATCCTTT
    AATGTGGTAGTTGGTAATAATAAGATGAAATTCCTCTGTTGTTAGTAAAATTATGAAATTGAAGTTCTGCAGCATGTCAGGCCAGG
    ATTATTAGGGAGATTCCTCGAAACTAGTGTGTGTTTATTAAAAGGAGAAAGGATAACAATAGAATGTTCTAAAACCAGAAGTCCAA
    GTGCGTGTCTACTTATGGGACCAATAAATAAAGAACAGACATTTGATTTGAGGTGAGGTAAAAGCCTGAAACATGGAATGGCATTC
    TGTTTTGATGGATTTTCATTTCTTCGCACTTCTGAGACGGCAAAGCCAACCACTTAGAAGCCTTCCACATCTTTGTCACCTGCCTG
    GCTCCTGCTCTCTGATGTACCTCTGGGTAGTGAGATGGAAATGGTGCCTGCAGAAGTTGGGGAGAAGGATACTTTTGCACAGCCTC
    CATGATGTCTTTATTGCAAATATGGATGACAAGGGTCTCTGTTACAGGGGCCTCAGAGCACCTTCGTTTCTCCTCTAGACCAGGGA
    CAGGTGTAGAGATAAGGACTGGCAACCAGAGCCTCAGCATCCAAAGATGGACTGAAGTGGGATGGCTGACAGGCACATAACTTACG
    GGAAAGGGAATTTCATACATACGATTTTTGTTTTGTGGGTAGGAGGGCTTATCATCAACACTGATTTTATAATCTGACAATAAATG
    TCTTTCATTAAAGAGTTTACCTAAATGAAAAAAAAAAAAAAAAAAAAAAAAAAA

147 GCGGGCGCGGACTGAGGCTGCGCGCCGCAGGTTCCGGCTGCTGGCGGCGTTGCGGCCGCAGGTTTGACTCCCGTGCGGTGCGGCCC
    AGCAGCCACAAAGCTCCCGCTGCCATTGCTCCTTGTACTCCCGCCGCTCACTGCCGCTGTCCAACCCTCCCCCGGGGCTTGCGCGG
    CGGCTCCCACACCCCTCGGCCCGTGTACGCGCTCTGCACCTGCCTGCCCGAAAACATGTTGCAGACACCAGAGACGCAGGGGCTCC
    CGGTCCCGCAGGCCGAGGGGGAGAAGGATGGCGGCCATGATGGTGAGACCCGGGCCCCGACCGCCTCGCAGGAGCGCCCCAAGGAG
    GAGCTTGGCGCCGGGAGGGAGGAGGGGGCTGCGGAGCCCGCCCTCACCCGGAAAGGCGCGAGGGCCTTGGCGGCCAAAGCCTTGGC
    AAGGCGCAGGGCCTACCGCCGGCTGAATCGGACGGTGGCGGAGTTGGTGCAGTTCTTCCTGGTGAAAGACAAGAAGAAGAGTCCCA
    TCACACGCTCGGAGATGGTGAAATACGGTTATTGGAGACTTGAAGATTCTGTTCCCGGACATCATCGCAAGGGCCGCAGAGCATCTG
    CGGTATGTCTTTGGTTTTGAGCTGAAACAGTTTGACCGCAAGCACCACACTTACATCCTGATCAACAAACTAAAACCTCTGGAGGA
    GGAGGAGGAGGAGGATCTGGGAGGAGATGGCCCCAGATTGGGTCTGTTAATGATGATCCTGGGCCTTATCTATATGAGAGGTAATA
    GCGCCAGGGAGGCCCAGGTCTGGGAGATGCTGCGTCGGTTGGGGGTGCAACCCTCAAAGTATCATTTCCTCTTTGGGTATCCGAAG
    AGGCTTATTATGGAAGATTTTGTGCAGCAGCGATATCTCAGTTACAGGCGGGTGCCTCACACCAATCCACCAGAATATGAATTCTC
    TTGGGGTCCCCGAAGCAACCTGGAAATCAGCAAGATGGAAGTCCTGGGGTTCGTGGCCAAACTGCATAAGAAGGAACCGCAGCACT
    GGCCAGTGCAGTACCGTGAGGCCCTAGCAGACGAGGCCGACAGGGCAGAGCCAAGGCCAGAGCTGAAGCCAGTATGAGGGCCAGG
    GCCAGTGCTAGGGCCGGCATCCACCTCTGGTGAGGGTTGGTGAAAAGTTGGCCAGTGGGTCCCCGTGAGGACGAACTACTGTCCTG
    AGTCATAAGTAATATGGGTGGGGCGAGGGTCTTATTCTGTAGAAATCGTGTGACTTTAAGGATTTAGATTTTGTATCTTATGTTT
    TGTAACATTTAATAATTACTGTTAAAATGCTGTTTGTAAATGAGATTGGTCTACTTTTTCCTGTAGGATTTTATTGTAGAGTTTTG
    CTGGTTTTGTAAAATGGATGGAAGAACTTTGTATTTATACTGTGATTTTGAACAGATTATGCAACATTGGAAGGAAGGCTGTACTT
    TGATGGTTTGAAGGAACTCAGCAGTATGATGATCTGGTTCCAGGGGAAAAAATAGCTGGTTGGTGTCTAGCCCCCCAACACTTTT
    GTCTGTTGTGTATAAAAGAAGAAAGACTGGCATGTACCTTCATTTGCTTAGCTATTTGAGTATCTAGAGAAAAATTAAAATGCAAT
    GAGTTAGCAGTATACCCTGGCACACTTAATAAATTAAACATTTGTGGAAAAAAAAAAAAAAAAAAA

148 GCGCGGTAGCATCGCGGAGTCGGTGCTTTAGTACGCCGCTGGCACCTTTACTCTCGCCGGCCGCGCGAACCCGTTTGAGCTCGGTA
    TCCTAGTGCACACGCCTTGCAAGCGACGGCGCCATGAGTCTGACTGCCTCCAGTTCCAGCGTACGAGTTGAATGACTGCAGCAGTTAC
    CATTGCTGCTGGGACAGCTGCAATTGGTTATCTAGCTTACAAAAGATTTTATGTTAAAGATCATCGAAATAAAGCTATGATAAACC
    TTCACATCCAGAAAGACAACCCCAAGATAGTACATGCTTTTGACATGGAGGATTTGGGAGATAAAGCTGTGTACTGCCGTTGTTGG
    AGGTCCAAAAAGTTCCCATTCTGTGATGGGCTCACACAAAACATAACGAAGAGACTGGAGACAATGTGGGCCCTCTGATCATCAA
    GAAAAAGAACTTAAATGGACACTTTTGATGCTGCAAATCAGCTTGTCGTGAAGTTACCTGATTGTTTTAATTAGAATGACTACCA
    CCTCTGTCTGATTCACCTTCGCTGGATTCTAAATGTGGTATATTGCAAACTGCAGCTTTCACATTTATGCGATTTGTCTTGTTGAA
    ACATCGTGGTGCACATTTGTTTAAACAAAAAAAAAAAAAAAAAAAAGGAAAAACCAACCTCATGGCCTGTGGGTTATTTTGGTCTTGT
    AAGGATCCATTTCTTTAAAATACTGACATATAGAGTTGTACCTTATATAGAATATAGTTGTATCTTGAAGTCAACATATTTAAATTA
    TTCTCAAAATTATGTATTTGCAGATTGTACTTGTAAGTTTCAAAGAAAAATTACCATCTTTTCATATTGACCTGGAAACTAAATAG
    GATGTGATTCAGCTACATTAATTTCTTAATCAACATCTAAAAAAAAAAAAAAAAAAAAAAAAA
```

TABLE 1-continued

Sequences Table. First column: SEQ ID No. Second column: corresponding mRNA sequence. For the 3 different groups, see explanation in the text.

149 GAGAAAGGAGAGAAAGGAAAGCGCGAGGAGCCGCCGCCACCACCAGCGCAGCAGTCCTGGAGCTGTGAGGAGATTCGGGCCGTCAC
CCTGCCTCCCCTGCGTCCCGCCACCGGCCGCTTCTGTCCTCGGACCCATTCCAACAATCTCGTAAAACATGGTGGATTACTATGAA
GTTCTAGGCGTGCAGAGACATGCCTCACCCGAGGATATTAAAAAGGCATATCGGAAACTGGCACTGAAGTGGCATCCAGATAAAAA
TCCTGAGAATAAAGAAGAAGCAGAGAGAAAATTCAAGCAAGTAGCGGAGGCATATGAAGTGCTGTCGGATGCTAAGAAACGGGACA
TCTATGACAAATATGGCAAAGAAGGATTAAATGGTGGAGGAGGAGGTGGAAGTCATTTTGACAGTCCATTTGAATTTGGCTTCACA
TTCCGTAACCCAGATGATGTCTTCAGGGAATTTTTTGGTGGAAGGGACCCATTTTCATTTGACTTCTTTGAAGACCCTTTTGAGGA
CTTCTTTGGGAATCGAAGGGGTCCCCGAGGAAGCAGAAGCCGAGGGACGGGGTCGTTTTTCTCTGCGTTCAGTGGATTTCCGTCTT
TTGGAAGTGGATTTTCTTCTTTTGATACAGGATTTACTTCATTTGGGTCACTAGGTCACGGGGGCCTCACTTCATTCTCTTCCACG
TCATTTGGTGGTAGTGGCATGGCCAACTTCAAATCGATATCAACTTCAACTAAAATGGTTAATGGCAGAAAAATCACTACAAAGAG
AATTGTCGAGAACGGTCAAGAAAGAGTAGAAGTTGAAGAAGATGGCCAGTTAAAGTCCTTAACAATAAATGGTGTGGCCGACGACG
ATGCCCTCGCTGAGGAGCGCATGCGGAGAGGCCAGAACGCCCTGCCAGCCCAGCCTGCCGGCCTCCGCCCGCCGAAGCCGCCCCGG
CCTGCCTCGCTGCTGAGACACGCGCCTCACTGTCTCTCTGAGGAGGGAGGGCAGGACCGACCTCGGGCACCCGGGCCCTGGGA
CCCCCTCGCGTCCGCAGCAGGATTGAAAGAAGGTGGCAAGAGGAAGAAGCAGAAGCAGAGAGAGGAGTCGAAGAAGAAGAAGTCGA
CCAAAGGCAATCACTAGACCGGACTTGAGGCACGCGGTGCACCCCCAGACGCTGGCGCTCCACCGTGCTCGGCATGCGGTCGTGCA
CACGCGCTAGGTAGCAGCGTCGGTCAGGACTGTCTCGAGGCCACACTCGCTCGGCAGGATTATGCGATCACGGATCAGTCAGAGCA
GGGTCAGGAGACGGGGCTGACGGCCACGGGTGCGGGGACAGACGTTTGGGACTTGGCCGCGACTCTCTGCTTCTCTCCAGCTCTCA
ATCTGCTGCATTTTCCTCTAGTGCTTCCGGATCCTCTTCATTCTTTTCGGCTACTCAACCACTCCGCATGCTGCTGGAATATTTCT
GGCTTTAGAAGTACAGGAGGGCGCAGATGGCTAACTGAGTAACATTCATGAAATGAGGCTTTCTGTGGCGGCGTAGTGTTTGGAAT
TAGAAGGTAATTCAGTAGAGTGTAACTTAGAGAATATTGCAAGTGACACATTGAATCCTGCCCGTCAGGGCACCTTTTCCTCAGAG
CAATCCGGCCACACGAATAGAAGGCTGTCGTGAATCACATCAGATGTAAAATCATTCCTTCTGTTTACTCTTTTAATTTTCATCCT
TTGCAGGTAGTGCAAATTCAACTTCAAATATGGTGTAGGTTTTGCTAGATTCCATATTTTTTCTTGGATTTTTGCTAATTATTTT
TAGCAAAAAATTTTTGCTCAGTGGCACTCTCCCTAGTGTCCATGGGTTAGGGCCATGCTGGGGAAAACGGGCCGGTATTTACACAC
GCGCAAAACACCCAGAGACGGCACAAGGAGGTTGAACTCATGTTTCAGTTCGCGAACATTGACTCCTTACGAAAGTCACTTCATTC
TAACTAGATGCGCCCACTTCCGGTCATTATTTCGTTTGCATGATGTATTGCTTCTTCACGTTTTGTTTTTATTGAGCACGGAGTAG
AATTCCAGGGCTGCCTTGACTTCTTCCCTGCATGCTCCCTCCCAGTGACTTTCCTTCCCTTTCACATGAGGATCTGCCGTTCATGT
TGCTTTCTCCTTTGTCCTCTTGGACTTGAGGGCATTGTGAAAAGCTTTGCTGTGATTTAAAAATGCCAGCAATTTTAATCTAGCAG
TGTTGAAGCTGGGAATTTTTGGCGCAATCCATGTAGCAGTGACCCAGGCTTGGGAGCCAGAAACAAGTGTGACCTGGGATTTTAT
TTAACACAACTGTTGCCAAAGAGTTGGCTTTGTTTATTTGGTTTTGGCGGGGAGAGGAGTGGTATTTGATGCTTTCTGTGGACAAT
GTAACCCTAAACACATCATGTATTTTAAATGCCACCTACATAAATAAAACATAAGCATATTGAATACAAAAAAAAAAAAAAAAAAA

150 GGAGTGAGGGGAGCAGTTGGGCCAAGATGGCGGCCGCCGAGGGACCGGTGGGCGACGGCGAGCTGTGGCAGACCTGGCTTCCTAAC
CACGTCGTGTTCTTGCGGCTCCGGGAGGGACTGAAAAACCAGAGTCCAACCGAAGCTGAGAAACCAGCTTCTTCGTCGTTGCCTTC
GTCGCCGCCGCCGCAGTTGCTGACGAGAAACGTGGTCTTTGGCCTCGGCGGAGAGCTTTTCCTGTGGGACGGAGGAAGACAGCTCCT
TCTTAGTCGTTCGCCTTCGGGGCCCCAGCGGCGGCGGCGAAGAGCCCGCCCTGTCCCAGTACCAGAGATTGCTTTGCATAAATCCA
CCCCTGTTTGAAATCTATCAAGTCTTGTTAAGCCCAACACAACATCATGTAGCACTTATAGGAATAAAAGGACTTATGGTATTAGA
ATTACCTAAAAGATGGGGAAGAATTCTGAATTTGAAGGTGGAAAATCAACAGTGAATTGTAGTACCACTCCAGTTGCGGAGAGAT
TTTTCACCAGTTCCACCTCTCTGACTCTAAAGCATGCTGCATGGTATCCAAGTGAAATCCTGGATCCCCACGTAGTGCTGTTAACA
TCAGACAACGTAATCAGAATTTACTCACTACGTGAGCCGCAGACACCCACTAACGTGATAATACTTTCAGAAGCCGAAGAGGAAAG
TCTAGTACTCAATAAAGGAAGGGCGTATACCGCATCTCTAGGAGAGACAGCAGTTGCATTTGACTTTGGGCCATTGGCAGCAGTCC
CAAAGACTCTATTTGGACAAAACGGCAAAGATGAAGTAGTGGCATACCCACTGTACATCTTATATGAAAATGGAGAGACTTTCCTG
ACATACATCAGTCTGTTACACAGCCCTGGAAATATTGGAAAGCTGTTGGGTCCATTGCCCATGCATCCTGCGGCTGAAGATAACTA
TGGTTATGATGCGTGTGCTGTACTCTGCTTACCCTGTGTCCCCAATATCTTAGTGATCGCTACTGAATCAGGAATGCTGTATCACT
GTGTCGTGCTAGAAGGGAAGAAGAGATGACCACACGTCAGAAAAGTCCTGGGATTCAGGATTGACCTCATTCCTTCTCTGTAT
GTGTTTGAATGTGTTGAGTTGGAGCTTGCTTTGAAACTGGCATCTGGAGAGGATGACCCTTTTGATTCTGACTTTTCTTGTCCAGT
CAAACTTCATAGAGATCCCAAGTGTCCTTCAAGATATCACTGTACTCAAGTGGTGTCACATAGTGTTGGCGTAACTTGGATTC
ATAAACTTCACAAATTTCTTGGATCAGATGAAGAAGATAAGGATAGTTTACAGGAACTCTCTACAGAACAGAAATGCTTTGTTGAA
CACATCCTTTGTACGAAGCCATTGCCCTGCAGGCAGCCAGCTCCAATTCGAGGATTTTGGATTGTACCTGACATTCTGGGACCCAC
GATGATCTGCATCACCAGTACCTATGAATGCCTCATATGGCCGTTATTAAGTACAGTCCATCCAGCGTCTCCTCCCCTGCTTTGTA
CTCGAGAAGATGTTGAAGTGGCAGAGTCTCCCCCTCCGTGTTCTGAAGTCCCAGATTCCTTTGAAAAGCATATTAGAAGCATT
TTGCAACGTAGTGTTGCCAATCCAGCATTTTTGAAAGCTTCTGAAAAGGACATAGCCCCTCCTCCTGAAGAATGCCTTCAGCTCCT
CAGCAGAGCCACCCAGGTGTTCAGAGAGCAGTACATTCTCAAACAGGACTTGGCAAAGGAGGAGATTCAGCGGAGGGTCAAATTAT
TATGTGACCAAAAAAGAAACAACTAGAAGATCTCAGTTATTGTCGAGAAGAGAGGAAAAGTCTGCGGGAAATGGCTGAGCGTTTA
GCTGACAAATATGAGGAAGCTAAAGAAAAACAAGAGGATATCAGTGAAAATACTTCACAGTTTTCACTCTGAGCT
CCCAGTTCTCTCTGATAGTGAGCGAGACATGAAGAAAGAATTACAGCTGATACCTGATCAACTTCGACATTTGGGCAATGCCATCA
AACAGGTTACTATGAAAAAGGATTATCAACAGCAAAGATGGAGAAGGTGTTGAGTCTTCCAAAACCCACCATTATTCTCAGTGCC
TACCAGCGAAAGTGCATTCAGTCCATCCTGAAAGAGGAGGGTGAACATATAAGGGAAATGGTGAAGCAAATCAATGATATCCGAA
TCATGTAAACTTCTGACACCACCAGGAGCTGACTCACACCTGAACTGAACACCATTGAAGGCTTAAACCCATATTGTAAAACAGGT
AGAATTATCTAATTTATAAAAAGGTGTTTTGATGACAAAAAAAAAAAAAAAAAAAAAA

151 GACAATATCAGGTGAGCTGTGGAGGTGGGGTCCTTGGAAGCTGGATGACAGCAGCTGGCAAGGGGATAAGAGAGCAGTGAGCCCCT
CCCTCAAGGAGGTCTGGCTTTATCCATAGACAGGGCCCTCTGAGGTGGGGCTGAGGTACAAAGGGGGATTGAGCAGCCCAGGAGAA
GAGAGATGGGGGTTCCCTTCTTCTTTCTCAGATGCATGGTGGACTTAGGGACCTTGCTGGGCTGGGGGTCTCACTGCAGAGATG
AAGCTGCTTCTGGCCCTAGCAGGGCTCCTGGCCATTCTGGCCACGCCCCAGCCCCTCGAAGGTGCTGCTCCAGCTGTCCTGGGGGA
GGTGGACACCTCGTTGGTGCTGAGCTCCATGGAGGAGGCCAAGCAGCTGGTGGACAAGGCCTACAAGGAGCGGCGGGAAAGCATCA
AGCAGCGGCTTCGCAGCGGCTCAGCCAGCCCCATGGAACTCCTATCCTACTTCAAGCAGCCGGTGGCAGCCACCAGGACGGCGGTG
AGGGCCGCTGACTACCTGCACTGCCTCTAGACCTGCTGGAGAGGAAGCTGCGGTCCCTGTGGCGAAGGCCATTCAATGTCACTGA
TGTGCTGACGCCCGCCCAGCTGAATGTGTTGTCCAAGTCAAGCGGCTGCGCCTACCAGGACGTGGGGGTGACTTGCCCGGAGCAGG
ACAAATACCGCACCATCACCGGGATGTGCAACAACAGACGCAGCCCCACGCTGGGGGCCTCCAACCGTGCCTTTGTGCGCTGGCTG
CCGGCGGAGTATGAGGACGGCTTCTCTCTTCCCTACGGCTGGACGCCCGGGGTCAAGCGCAACGGCTTCCGGTGGCTCTGGCTCG
CGCCGGTCTCCAACGAGATCGTGCGCTTCCCCACTGATCAGCTGGACTTGCTCCTCGACATCTCCATGTTCATCATGGTCACTGA
AGCTGTTGGACCACGACCTCGACTTCACCCGTGAGCCGGCCGCCCGGGCCTCCTTCGTCACTGGCGTCAACTGCGAGACAGCTGC
GTTCAGCAGCCGCCCTGCTTCCCGCTCAAGATCCCGCCAATGACCCCGCATCAAGAACCAAGCCGACTGCATCCCGTTCTTCCG
CTCCCTGCCCGGCTTGCCCCGGGAGCAACATCACCATCCGCAACCAGATCAACGCGCTCACTTCCTTCGTGGACGCCAGCATGGTGT
ACGGCAGCCGAGGAGCCCCTGGCCAGGAACCTGCGCAACATGTCCAACCAGCTGGGGCTGCTGGCCGTCAACCAGCGCTTCCAAGAC
AACGGCCGGGCCCTGCTGCCCTTTGACAACCTGCACGATGACCCCTGTCTCCTCACCAACCGCTCAGCGCGCATCCCCTGCTTCCT

TABLE 1-continued

Sequences Table. First column: SEQ ID No. Second column: corresponding mRNA sequence. For the 3 different groups, see explanation in the text.

```
    GGCAGGGGACACCCGTTCCAGTGAGATGCCCGAGCTCACCTCCATGCACACCCTCTTACTTCGGGAGCACAACCGGCTGGCCACAG
    AGCTCAAGAGCCTGAACCCTAGGTGGGATGGGGAGAGGCTCTACCAGGAAGCCCGGAAGATCGTGGGGGCCATGGTCCAGATCATC
    ACTTACCGGGACTACCTGCCCCTGGTGCTGGGGCCAACGGCCATGAGGAAGTACCTGCCCACGTACCGTTCCTACAATGACTCAGT
    GGACCCACGCATCGCCAACGTCTTCACCAATGCCTTCCGCTACGGCCACACCCTCATCCAACCCTTCATGTTCCGCCTGGACAATC
    GGTACCAGCCCATGGAACCCAACCCCCGTGTCCCCCTCAGCAGGGTCTTTTTTGCCTCCTGGAGGGTCGTGCTGGAAGGTGGCATT
    GACCCCATCCTCCGGGGCCTCATGGCCACCCCTGCCAAGCTGAATCGTCAGAACCAAATTGCAGTGGATGAGATCGGGGAGCGATT
    GTTTGAGCAGGTCATGAGGATTGGGCTGGACCTGCCTGCTCTGAACATGCAGCGCAGCAGGGACCACGGCCTCCCAGGATACAATG
    CCTGGAGGCGCTTCTGTGGGCTCCCGCAGCCTGAAACTGTGGGCCAGCTGGGCACGGTGCTGAGGAACCTGAAATTGGCGAGGAAA
    CTGATGGAGCAGTATGGCACGCCCAACAACATCGACATCTGGATGGGCGCGTGTCCGAGCCTCTGAAGCGCAAAGGCCGCGTGGG
    CCCACTCCTCGCCTGCATCATCGGTACCCAGTTCAGGAAGCTCCGGGATGGTGATCGGTTTTGGTGGGAGAACGAGGGTGTGTTCA
    GCATGCAGCAGCGACAGGCCCTGGCCCAGATCTCATTGCCCCGGATCATCTGCGACAACACAGGCATCACCACCGTGTCTAAGAAC
    AACATCTTCATGTCCAACTCATATCCCCGGGACTTTGTCAACTGCAGTACACTTCCTGCATTGAACCTGGCTTCCTGGAGGGAAGC
    CTCCTAGAGGCCAGGTAAGGGGGTGCAGCAGTGAGGGGTATATCTGGCTGGCCAGTTGGAACCACGGAGATCTCCTTGCCCTAGA
    TGAGCCCAGCCCTGTTCTGGGTGCAGCTGAGAAAATGAGTGACTAGACGTTCATTTGTGTGCTCATGTATGTGCGAAGTATATAAA
    TTGGCTTTTCATGCGTGTGTGTTGTCTGAACATGGGGAGTGTTTCATGGGTTATGTGTATGTGCCATTTATGTGAGTGTGTGTTTG
    TGCTGATGAGAATACTGAGTATGTGGAAGGCAGCAGAGCGGACTGGTGAGGAGCACAGCTCAGGAACTAGACTGCCTGGGTTCCAA
    TCCTGGCTCTGTGGCTTGCTAGCTATGTGACCTTGAGCAAATTACCCTCCTTAAACAAGAGTTTTCTTCCTTGTAAATTACATCTG
    TCATGGTTTCTTGGAGGGCCCACTTGTATCCTCTGGTTCTTCATTTATTGAGCACCTACTACATGCAAGGCACTGTACTAGGCGTG
    AGAAGCATATAGAGGCAAGAAGAGATACCAAGATGCCATCTGTGTCCTGGTTAGCAGAGCTGGACCAGTGGTGCCTTGGAGGGAT
    AAGCCAGCTGCAGCTGGGCGTGTGGTTGACTTATGGGCCCAGCCAGCCAGGCTCAGGCCATGGCTCCCCTTTTTCTTCCTCACCC
    TGATTTCTTGCTTATTCACTGAAGTTCTCCTGAAGAGGAACTGGGCCTGTTGCCCTTTCTGTACCATTTATTTGCTCCCAATGTTT
    ATGATAATAAAGGCACCGCTGATGGGGACCTCC

152 AAAGTGGCTGAATGAGAAATGTAGATTGCAGAGGGCAACTGGTGTGTTTATATGCCTGACATTATTTGGGTTTTCCCCCCTCAGGC
    AGAAGCTGAGGAAGATTGTCATTCTGATACTGTCAGAGCAGATGATGATGGAAGAAAATGAAAGTCCTGCTGAAACAGATCTGCAGG
    CACAACTCCAGATGTTCCGAGCTCAGTGGATGTTTGAACTTGCTCCAGGTGTAAGCTCTAGCAATTTAGAAAATCGACCTTGCAGA
    GCAGCAAGAGGCTCTCTCCAGAAAACATCGGCAGATACCAAAGGAAAACAAGAACAGGCAAAAGAAGAAAAGGCTCGAGAACTCTT
    CCTAAAAGCAGTAGAAGAAGAACAAAATGGAGCTCTCTATGAAGCCATCAAGTTTTATCGTAGGGCTATGCAACTTGTACCTGATA
    TAGAGTTCAAGATTACTTATACCCGGTCTCAGATGGTGATGGCGTTGGAAACAGCTACATTGAAGATAATGATGATGACAGCAAA
    ATGGCAGATCTCTTGTCCTACTTCCAGCAGCAACTCACATTTCAGGAGTCTGTGCTTAAACTGTGTCAGCCTGAGCTTGAGAGCAG
    TCAGATTCACATATCAGTGCTGCCAATGGAGGTCCTGATGTACATCTTCCGATGGGTGGTGTCTAGTGACTTGGACCTCAGATCAT
    GGGAGCAGTTGTCGCTGGTGTGCAGAGGATTCTACATCTGTGCCAGAGACCCTGAAATATGGCGTCTGGCCTGCTTGAAAGTTTGG
    GGCAGAAGCTGTATTAAACTTGTTCCGTACACGTCCTGGAGAGAGATGTTTTTAGAACGGCCTCGTGTTCGGTTTGATGGCGTGTA
    TATCAGTAAAACCACATATATTCGTCAAGGGGAACAGTCTCTTGATGGTTTCTATAGAGCCTGGCACCAAGTGGAATATTACAGGT
    ACATAAGGATTCTTTCCTGATGGCCATGTGATGATGTTGACAACCCCTGAAGAGCCTCAGTCCATTGTTCCACGTTTAAGAACTAGG
    AATACCAGGACTGATGCAATTCTACTGGGTCACTATCGCTTGTCACAAGACACAGACAATCAGACCAAAGTATTTGCTGTAATAAC
    TAAGAAAAAAGAAGAAAAACCACTTGACTATAAATACAGATATTTTCGTCGTGTCCCTGTACAAGAAGCAGATCAGAGTTTTCATG
    TGGGGCTACAGCTATGTTCCAGTGGTCACCAGAGGTTCAACAAACTCATCTGGATACATCATTCTTTGTCACATTACTTACAAATCA
    ACTGGTGAGACTGCAGTCAGTGCTTTTGAGATTGACAAGATGTACACCCCCTTGTTCTTCGCCAGAGTAAGGAGCTACACAGCTTT
    CTCAGAAAGGCCTCTGTAGAGCCTCAAGTCCAGTCCTCTATCACTTTTGCATGAATTAAAGTATATAGCGCAAAAGAGCACCTAAG
    TTATAAATGTGTGTGTGTGTGTGTGTATATATATATATATATATATATATATATATATATATATATATATATATATGGAATTGG
    AACTTATTTTAAATTGTTGGAGTTCTTTTAAGAAGAATATAAATTGATTATTTTTTTATTTAAAGGGATTGTTGATTTCCTGGGGT
    GTTTTGAAATTAAGTTGGAATTAAGTTGCTTAAGCATATTTATGTTGTGAGAAACCTTAATATGAGGTTTATCATGCCCTTTTTCA
    AGCAGATTTATGAGCAGATTTCTGTCACATAAGTCGTCTTCTGCTTGAGTATCCTAATATTTCAATGCATCAGGGGAGCGCTCCAC
    TGGATAAGCATTTTATTTCCCGCATGGCATAATGTTTTGCACTAAAGGCTCAAAGTGTGAGAACCTGTTCTGGATTTGTTTGAAA
    TTATTTCACCAATAAAGATCATAAATAAATGTTTCTTTCAAGAAAATATATTTGGATGGCCTTTTTAAAGTAACAGGATATTTAAT
    AAGAGTCCTAGATAGCCAGCGGAGACTTTAAGAATCATTGCCTCTAGCTGGGTGTGGTGGCATGCACCTGTAGTCCCAGCTATTTG
    GGAGGCTGATGCAGGAGAATAGCTTAAGCCCAGGAATTTGAGTCTGGGAGTTTGAGTCCAGCATGGGCAACATAACAAGACCCCAT
    CCCTTATTAAAAGAAAAAAAAATAATTCCTCATTTCATCATTGGTCTTTATATGTAGCCACAAACACTGACCTCATGTAGGCACCT
    TACCAATATATGACATTAAGTGAGAGTGAATCCCTTAGGACTGGACACTTCAAGCTCAACCAACTGACTCAGTTGTCATTCTTCA
    CAAAAGAATAGTAGAGGATCATGTAAACCTGAGCCTAACTCTTGTTCCAGTATGAAAGTTGGGGGAGAGCACCAGCCACCTAGGAA
    AACTGTATGTTACCTTTTTACTCAAAGGAGTCCCCCTGCCCAGTAACAGTCCTATTAGTGTTTAATTTCAGAGTTTGTGTCTGGT
    AGACCTCTACCTGATTCAGATTTGGTTTTGTTGTTTCAACCATAGTTAGAGACAAATTCTCATGTACTTTCAGAAATCAATATCTG
    CAGCCACTGTTACTTTTAATTGACATTAAGAGACACTTCATAGGTTCCCACAATTCAGTATGGGATAGGCTTTTTAAAAAGCACAT
    ACAGACCAGGCGTGGTGGCTCATGCCTATAATCCCAGCACTTTGGGAGGCTAAGACAGGCAGATCACCTGAGCTCAGGAGTCCAAG
    ACCAGCCTGGGCAACATGGCAAAACACCGTCTCTACAAAAAAAAAAAAAAAAAAATTAGCCAAGTACAGTGGGGCACACCTATAG
    TCGCAGCTACTTGGGAGGCTGGGCAGGAGAATTGCCTGAGCCTGGGAAGTGGAAGTTGCAGTGAGCCAAGATCGTGCCATTCCAC
    TCCAGCCTGAGCAACACAGTGAGACCCTATCTCAAAAAAATAATGATGATAGTACACGTTATGTTAAAGGTGAAATGTGCATACAG
    AAGGAAGAGAGTTGGCCAGGTGTGGTGACTCACACCTATAATCCCAATACTTTGGGAGGCCAAGGCAGGAGGATTGCTTGAGGTCA
    GGAGTTTTAGACCAGCCTGGACAACATAGCAAGACCTCATCTCTTCTAAAAATTAAAAAAAAAAAAA

153 GGCTCAAACATGGCTGCGCTGAGAGCTCTATTGCTTTGGGCGCCGGGACAGGAGGTACTCCGCGAATGAGAACATTGAGAATGTG
    TTCGGCATAACTCATTTCTTTGTATCTCCCTGCACTCTGTTGCAGGAAGGAATGAATCATCCATTTGGAAAAGAGGAACCTGCTTCGC
    AGAAGCAGCTTTTTGGATTTTTCTGCGAATGCCTGCGGAGGGGAGAATGGGAGCTGGCACAGGCATGTGTACCTCAGCTACAGGAG
    GGACAAGGGGATATCCAAAGAGGGTAGAAGACATACTTCAGGCATTGGTGGTGTGTCCAAATCTGCTGAGATGTGGGCAGGACAT
    CAACCCTCAAAGAGTAGCCTGGGTCTGGCTTCTTGTACTGGAGAAATGGTTGGCCCGGGAAAAGAAGTTACTCCCAGTTGTTTTCC
    GGAGAAAGCTTGAGTTTCTTTTATTGTCAGAAGACCTCCAAGGTGACATTCCAGAGAACATCCTCGAGGAGCTGTATGAGACCTTA
    ACACAGGGTGCAGTAGGCCACGTGCCTGACGGAAATCAAGGAGGGAGAGCTGGACTCCTCGTCTCAGCCTCCGAAGCTGTCTCTGT
    GCTCTGGGATCCTGAGGCAGTCTCCCCAGCCAGCACAGGCCCTGCTGGAGCTCCTGCTTGAGGAGGATGACGGTACTGGCCTCT
    GTCACTGGCCTCTGCAGAATGCACTGGTGGACCTCATTCGAAAGGCATTGCGGGCTTTGCAGGGCCCTGATTCGGTGCCCCTGGG
    GTAGTCGATGCCATCTATGGAGCCCTGCGGACTCTGCGTTGCCCCGCAGAACACCTTGGGGTTGAGTTGCATCTCCTGTGTGAGGA
    ACTACTAGAGGCCTGCAGGACCGAGGGGAGTCCCCTGCGGGAGGAGGCGGCTGCTCAGCTGCCTGCTGCACAAGGCCAGCCGGGGCC
    TGCTGTCCCTGTATGGCCATACCTATGCAGAAAGGTCACAGAAAAGCCACCGAGGGCTACAGCCTCGGGAAAAGTCTCACCGGAT
    CATCTAGATCCTGAGCGGGCAATGCTAGCCCTGTTCTCCAATCCCAACCCAGCCGAGGCTTGGAAAGTGGCCTATTTCTACTGCCT
    GAGCAACAACAAACACTTCCTCGAGCAGATTCTGGTAACAGCACTAACATTGTTGAAAGAAGAAGACTTCCCAAATCTTGGCTGCC
    TACTTGATAGAGAATTCAGGCCCCTCAGTTGCCTGCTTGTACTCCTGGGCTGGACACACTGCCAGAGCCTAGAGTCAGCCAAGAGG
```

TABLE 1-continued

Sequences Table. First column: SEQ ID No. Second column: corresponding mRNA sequence. For the 3 different groups, see explanation in the text.

CTGCTCCAGACCCTGCACAGGACCCAGGGCCCAGGCTGTGATGAGCTCCTCAGGGATGCCTGTGATGGGTTGTGGGCTCACCTGGA
GGTCCTGGAGTGGTGCATACAGCAGAGCAGCAACCCCATACCAAAGAGAGATCTGTTGTATCATTTACACGGTGGAGACAGCCACT
CAGTGCTCTACACTCTCCATCACCTTACAAACCTTCCAGCCCTCAGGGAGGAAGATGTTCTCAAGCTCTTACAGAAAGTGCCAGCC
AAGGACCCCCAGCAAGAGCCTGATGCAGTTGATGCTCCAGTCCCTGAGCACCTGACCCAGTGTCAGAACCTGACACTCTACCAGGG
CTTCTGTGCCATGAAGTATGCCATCTATGCCCTCTGTGTAAACTCACACCAGCACTCCCAGTGCCAGGACTGCAAAGACAGCCTCT
CTGAGGACCTGGCCTCAGCTACAGAGCCAGCGAATGACTCTCTCTCCTCCCCAGGTGCTGCAAATCTCTTCTCAACTTACCTGGCC
AGGTGTCAACAGTATCTGTGCAGTATTCCTGACTCTCTGTGCCTGGAGCTTCTGGAAAACATCTTCTCATTGCTTCTCATCACCTC
TGCTGATCTTCACCCAGAGCCTCACTTGCCTGAGGACTATGCTGAGGATGATGACATTGAGGGGAAGAGCCCCTCAGGTTTGAGGT
CCCCATCAGAGAGCCCTCAGCACATAGCACATCCTGAAAGGAAGTCAGAACGGGGTTCCCTGGGAGTCCCAAAGACCCTTGCTTAT
ACAATGCCAAGCCATGTGAAGGCAGAGCCAAAAGACAGTTACCCAGGGCCTCATAGGCACAGCTTTTTGGACTTAAAACACTTTAC
TAGTGGTATCAGTGGATTTCTGGCTGATGAATTTGCAATAGGGGCCTTCCTCAGGCTTCTCCAAGAGCAACTGGATGAGATCAGTA
GCCGCAGCCCCCTGAGAAGCCAAAGCAAGAAAGTCAGAGCTGCTCAGGAAGCAGAGATGGACTGCAGAGCCGCCTGCATCGACTT
TCCAAGGTTGTCTCTGAGGCCCAGTGGAGACACAAGGTGGTGACAAGCAACCATCGTTCAGAGGAGCAACCTTCCCGAAGATACCA
GCCTGCCACACGTCACCCCAGTCTCCGCCGGGGTCGTCGGACAAGAAGGAGCCAGGCAGATGGCCGAGACAGAGGTTCAAACCCAT
CCCTGGAAAGTACAAGTAGTGAGCTGAGCACAAGTACGTCAGAGGGAAGTCTGAGTGCCATGTCTGGCCGGAATGAGCTGCACAGT
AGATTGCACCCCCATCCTCAAAGTTCACTCATCCCCATGATGTTCTCCCCACCTGAGTCACTGCTGGCATCCTGCATCCTTCGCGG
GAACTTCGCAGAAGCCCATCAGGTGCTGTTCACGTTCAACCTGAAGTCCTCACCCAGTTCAGGGGAACTGATGTTCATGGAGCGCT
ACCAGGAAGTGATCCAAGAACTGGCCCAAGTAGAGCACAAGATTGAAAACCAGAACTCAGATGCGGGTAGCAGCACCATTCGGAGA
ACTGGCAGTGGCCGCTCAACTCTACAGGCCATTGGCAGCGCTGCAGCAGCAGGAATGGTGTTTTACTCTATCTCTGACGTGACTGA
CAAGCTGCTCAACACCTCTGGAGACCCCATCCCCATGCTCCAGGAGGACTTTTGGATAAGCACGGCTCTAGTGGAGCCCACTGCTC
CCCTGAGAGAGGTTCTGGAAGACCTCAGTCCCCCTGCCATGGCTGCATTTGACCTAGCTTGCTCTCAGTGCCAGCTCTGGAAAACC
TGCAAGCAGCTTTTGGAGACAGCCGAACGGCGTTTGAATAGTAGCCTTGAAAGGCGGGGTCGACGGATAGACCACGTACTCCTAAA
TGCTGATGGCATTCGAGGTTTTCCAGTTGTTCTTCAGCAAATCAGTAAGAGTCTCAATTATCTGCTTATGTCAGCCAGTCAAACCA
AATCAGAGAGTGTGGAAGAAAAGGGAGGAGGCCCTCCACGGTGCAGCATCACTGAACTGCTTCAGATGTGCTGGCCCAGCCTAAGC
GAGGACTGTGTTGCCAGCCACACCACCCTCTCCCAGCAGCTAGATCAGGTTCCTTCAGTCACTGAGAGAGGCACTAGAGCTGCCAGA
GCCCAGGACTCCTCCACTGTCTTCCCTGGTGGAGCAGGCAGCCCAGAAAGCTCCAGAGGCAGAGGCCCACCCTGTGCAGATCCAGA
CTCAGCTCCTCCAGAAGAACCTGGGCAAACAGACCCCATCAGGCAGCAGGCAGATGGACTACTTGGGCACCTTCTTCAGTTACTGC
AGCACCCTTGCTGCAGTTCTCCTTCAAAGTTTGAGCTCTGAGCCTGATCATGTGGAGGTCAAGGTAGGAAATCCCTTTGTTCTGCT
GCAACAGAGCTCTTCCCAACTGGTGTCACATCTCCTGTTTGACAGAACAAGTTCCCCAGAGAGACTGGCAGCCCTTCTGGCCCAAG
AGAATCTCAGCCTAAGTGTGCCACAGGTCATCGTCAGCTGCTGCTGTGAGCCCCTTGCTCTTTGCTCATCCCGGCAAAGCCAGCAG
ACCTCCTCCCTCCTGACTCGTCTGGGTACTCTGGCCCAGCTACACGCCTCTCACTGCCTGGATGACCTCCCACTTTCTACACCGAG
CTCCCCGAGGACAACTGAGAACCCTACATTGGAAAGAAAGCCCTACTCCTCCCAAGGGACTCATCACTCCCAGCCCTCACCTCCT
CTGCCTTGGCCTTTCTTAAGTCACGCTCAAAGCTCCTAGCTACGGTGGCCTGCCTGGGGGCTTCCCCGAGGTTAAAGGTCAGCAAA
CCCAGCTTGTCATGGAAGGAACTTCGTGGCCGCAGGGAGGTGCCTCTGGCTGCAGAGCAGGTAGCCCGGGAGTGTGAGCGCCTTCT
GGAACAATTCCCTCTGTTTGAGGCCTTCCTCCTGGCTGCCTGGGAGCCCCTGCGAGGGTCTTTGCAGCAGGGGCAGAGTCTGGCAG
TGAATCTCTGTGGTTGGGCCAGTCTTTCTACCGTTCTCCTGGGCCTACATTCTCCCATTGCCCTAGATGTACTGAGTGAGGCTTTT
GAGGAATCCTTGGTGGCCAGAGATTGGTCCCGGGCCCTTCAGCTCACTGAAGTGTACGGGCGAGATGTGGACGATTTGAGCAGCAT
AAAGGATGCAGTCCTGAGCTGTGCTGTGGCATGTGACAAAGAAGGTTGGCAATACCTGTTTCCCGTGAAGGATGCATCTCTGAGAA
GTCGGCTGGCCCTACAGTTTGTGGACAGGTGGCCCCTGGAGTTCATGCCTGGAGATTCTGGCCTACTGCATTTCAGACACGGCTGTC
CAAGAAGGACTAAAGTGTGAGCTACAGAGGAAGCTGGCGGAGCTGCAGGTGTATCAGAAGATTCTGGGTTTGCAGTCTCCCCCAGT
GTGGTGTGACTGGCAGACCTTGAGGAGCTGTTGTGTTGAGGACCCATCAACTGTCATGAACATGATTCTAGAAGCACAGGAGTATG
AACTGTGTGAAGAGTGGGGCTGCCTGTACCCCATTCCAAGAGAACATTTAATCAGCCTTCATCAAAAGCATCTTCTCCACCTTCTA
GAAAGAAGAGATCATGCAAAGGCTCTGCAACTCCTGCGAAGAATCCCTGACCCCACCATGTGCCTTGAAGTGACAGAGCAATCCCT
CGACCAGCACACTAGCTTGGCCACTTCTCACTTCTTGGCCAACTACCTCACCACCCACTTCTATGGACAACTGACTGCTGTCCGAC
ACCGTGAAATCCAGGCGCTGTATGTGGGATCCAAGATTCTGCTGACCCTGCCTGAGCAGCACCGGGCCAGCTATTCCCACTTGTCC
TCTAACCCCCTGTTCATGCTGGAGCAGCTGCTTATGAACATGAAGGTGGATTGGGCCACTGTGGCCTGTGAGACTCTCCAGCAGCT
GCTGGTTGGACAGGAGATTGGCTTCACTATGGACGAGGTGGACTCACTGCTTTCCAGATACGCAGAGAAAGCCCCTGGACTTTCCAT
ACCCTCAGAGGGAGAAACGATCAGATTCTGTGATTCACCTCCAAGAAATTGTCACCAGGCTGCAGATCCCGAGACCCTCCCTAGA
TCACCATCACCAGAGTTCTCTCCTGCTGCTCCTCCTGGTATCTCCAGTATACATTCCCCTAGTCTAAGGGAAAGGAGTTTCCCACC
AACCCAGCCCTCACAGGAATTTGTGCCCCCAGCGACACCCCTGCCAGGCACAGTGGGTACCGGATGAGACTGAGAGTATCTGCA
TGGTCTGCTGCAGGGAGCACTTCACCATGTTTAACAGGCGTCATCATTGTCGCCGCTGTGCCGGCTAGTGTGCAGCTCCTGCTCC
ACTAAGAAAATGGTGGTTGAAGGCTGCAGAGAGAACCCTGCTCGTGTGTGATCAGTGCTATAGTTACTGCAACAAAGATGTACC
AGAGGAGCCTTCAGAAAAACCAGAAGCTCTAGACAGCTCCAAGAATGAAAGCCCTCCATACTCGTTTGTGGTGAGAGTCCCCAAAG
CAGATGAGGTGGAATGGATTTTGGATCTCAAAGAGGAGGAAATGGCTGGTGGCGGAGTGAATTTTACTATGAGCAGGCCCCAGC
GCCTCCTTGTGCATTGCCATCCTGAATCTGCACCGGGACAGCATTGCCTGTGGTCACCAGCTGATTGAGCACTGCTGCAGGCTCTC
CAAGGGCCTCACCAACCCAGAGGTGGATGCCGGGCTGCTCACGGACATCATGAAGCAGCTGCTGTTCAGCGCCAAGATGATGTTCG
TCAAAGCCGGCCAGAGCCAAGACTTGGCTCTTTGTGACAGCTACATCAGCAAGGTAGATGTGCTGAATATTTTAGTTGCTGCTGCC
TATCGCCACGTGCCATCTTTGGATCAGATCTTGCAGCCAGCTGCAGTAACCAGGCTAAGGAACCAGCTTTTGGAAGCCGAGTACTA
CCAACTGGGCGTTGAGGTCTTCCACCAAAAGATCTGGCTTGATCACCACCGGGGCCTGGCATCCTGGGGCATGGCCTGCCTCAAAGCCG
GGAACCTCACTGCTGCACGGGAGAAGTTCAGTCGCTGTCTGAAGCCCCCATTTGACCTCAATCAGCTGAATCATGGCTCAAGGCTG
GTGCAGGATGTGGTTGAGTACCACTAGAGTCCACAGTGAGGCCCTTTGTATCCTTGCAAGATGACGATTACTTTGCCACCCTGAGGGA
ACTGGAAGCTACCCTTCGGACGCAGAGCCTTTCTCTGGCAGTGATTCCTGAAGGGAAAATCATGAACAACACCTACTACCAGGAAT
GCCTCCTTTACACCCATCGACAACTATAGCACCAACCTGGCCATCATCAGCTTCTACGTCAGGAGGCGCACGCACCATCGAAT
CACCTTCTCAACAAGGAGAGTCCTCCAGAAGTTTTTATAGAAGGCATTTTCCAACCAAGCTATAAAAGTGGGAAGCTACACACTTT
GGAGAACTTGCTAGAATCATTGATCAACCTTGGAGAGCTGGGGAAAGTACTTGATTGCTGCCTGCCAACATTTACGAAGAAGAA
ACTACTACCACATTCTGTATGAGCTGCAGCAGTTTATGAAGGACCAAGTTCGGGCCGCCATGACCTGTATTCGGTTCTTCAGTCAC
AAAGCAAAGTCATATACAGAACTGGGAGAAGCTCATCATGGCTTCAAGCAGGTGCAGCTGCACCTGACCATCGCACGTGTCTAAGAAT
ATCCCGCAGCTCTGGAAGGAAGAAAACCACATTCTTCAGAAAGAAGATGACTGCAGCTGATGTGTCAAGGCACATGAACACACTTC
AGCTGCAGATGGAAGTGACCAGGTTCTTGCATCGGTGCGAAAGTGCTGGGACCTCTCAAATCACCACTTTGCCTCTGCCAACCCTG
TTTGGAAATAACCACATGAAAATGGATGTTGCCTGCAAGGTCATGCTGGGAGGGAAAAATGTAGAAGATGGTTTTGGAATTGCTTT
CCGTGTTCTGCAGGACTTCGGCTGGATGCTGCCATGACCTACCGAGACTGCCCGCCAGTTGGTGGAGAAAGAGATGACATCACAGTG
AGATCCAGCAACTGCTCAATGTGTCAGTGAGTCAGGCATGGCAGCCAAAGTGACGGGGACACCATCCTCCTCAACTGCCTGGAA
GCGTTCAAGAGAATTCCGCCCCAGGAGCTGGAGGGCCTGATCCAGGCAATACACTGATGATGACAACAAGGTTCGGGCCTACCTGAT
ATGTTGCAAACTGCGTTCTGCCTACTTGATTGCTGTGAAGCAAGAACACTCACGGGCCACAGCCCTTGTCCAGCAGGTGCAGCAGG
CCGCCAAGAGCAGCGGGGATGCAGTAGTGCAAGACATCTGTGCCCAGTGGCTTCTGACAAGCACCCCCGGGGTGCCCATGGCCCA
GGCTCCAGGAAGTGACCTTGGGCAGTGGGGCCAGGAACACGTGGCCTGAGAGCTGGGCAACAGCAGTGATGGCGATGCCCTCCACC

TABLE 1-continued

Sequences Table. First column: SEQ ID No. Second column: corresponding mRNA sequence. For the 3 different groups, see explanation in the text.

```
TCTTTCCTCCAGTGGAGTGGGACTTCTCTGGCTCTGCCCTAGGTTGGAAAGAGTTGGATTGGACCCTACTTGCCTTCCCGGGCAAG
GATAGGACCTTTCACGCAAGTGCCATGTTTCTCTAAAATTGTGGAATCTATGTGTGTTTGTCTGGAGATGGCCAGTTCTTTCTACC
TCAGAGTGAGTGAGTGAGTATGTGTGCACACACGTGTGCATGTTCCTGTGCGCTGATGTTTACGCCCAAGCATTTCTGAACAAATG
AAACTCTTCTCCATTTAAAAGAGGCACTTTACTTTAGACTTGCCACTCTGAAAACCTTCCCTGCGTTTTGGTTCTTGACCCGGGTT
GTCCTGTTTGTATAGTCCCCCCTCTGTGGACGTGCTTTAGTAGCTCCTCTTACCTAGAGGGCTTTTACAGAGAATTAGAGCAACAC
CAAAAGGATTGCCTCTTTTCCTTCCTTCCCATTCCAAAATTCAGAGATGGCTTTGGGGCAAGTGCTACCTGTGGAATAAACCTGTT
TTCCAGGTGTCTCTTCTCCCAAGCACAAGAAGTCCTGGAGTCTTTGGAAGGTAGTCTGAATAGAAGGGTTTTCAGGTGCAGGCATC
TGAAAGCTGTGGGTATGTGTATAAATGATCAGGTCTGTGAGGCTAACACGGGCAAGAGGGAAAGAAAGGCTAACCATCCAAACAGG
GATACAGGGGAGGCGGTGGGGGGTGGTGGGGGGAGCGGGTGCTCACAAGCACAGAGCTGCCTGTTGTGAATGTCCCTGCTGCAAAG
TTGGTGGGTGAGAGAATGGGACTTCCTCTTTGAGAGTCTGGGGAGAGAAAAGGTGGCCAGGATCCTAGGACTGAATGACTCGATTT
TACCTATTTGAGCTGCAGTCCTGTTTGCGCTCCTTGAATTGGTTAGGAAGCTGCTTCCTTTTCCCTCCTGCTTCCCTTCAGTCTCT
TCAGGACCACAGGATGGATATGCAGACATGTGGGGTCATTGGGAAGGGAGTGCGCTTCTTTTCTCTGTCTTAGAAAAGGGAGTCAA
GGGTTGGCTTTGGAATTGGGCCTCTGGACAGAGTCAGAATGAGGGAATAATGAATAGGTCACATCTGGTTGGTGGAAAACTAGGTG
AAGTGCTTCTTTAATATGCACTGTCTTGTCTTCCCACGCAAGATGTGACAATGTTTGAGAAAAGGTGTGTCATACTCAGTGACTTC
AATTTGCAAATGTGGGGCCTAAAGAAAGCTCTGCAGCTCTGAACCTCTCACTGGCCAGAGCTCAGCCTATTGGTCCCATCCATGAT
GCTGAGACAAACAGAAACTGGAAGCTGAAGTCAGTGTCTCTGGTGCTTAGAAACCCTGTGGATTTCCCTCTGAACCAAGATTTTTA
GTAGTAAAATAAACAACTCATGGACATCTGTCAGATGAGAAGTTTTGGTCCTGTTAGAGAGGAGAAAGACTGTAATGAAACTACTA
GACCCATTTGGGCTAAAGTTTGGCTTTTCCTTCCTTGAGTCATAGAACATATCCATCTCCCAGGAAATGTCCTTCTCTGGCGTCTG
CTTGCCCTTCTGAGTCTGCCTTTTTTGCACTGAACATAAGCACTTTATACTAATGGGTCACAAATCTTGCAGCCCTTAATTTGGGA
TAAGACCAGATTTTCCTGACATTTTCCTCTAACTCATTGAACTATCAAATTATAGGCAACCACTGACTAGACTGATATGAGATGAG
GCTAAAAGCCTTTGAACACCACGCTGTAGTCTCCAACAGAAAAACACCACCAAAACAGATACCCATGTTGAGGGGTTGAATGTTTT
ACTACAAACAAGCCACAATAAAGTGTCTATCAACATGAAAAAAAAAAAAAAAAAA
```

TABLE 2

The Genbank accession number as on the microarray, name and Unigene name of the candidate sequences of Table 1. Some names were not available. EST: expressed sequence tag. In the first column the corresponding SEQ ID NO.

| | GENBANK™ Accession number | Name | Name (official UNIGENE™ name) |
|---|---|---|---|
| | | | Group 1 |
| 1 | AA281932 | PBEF1 | PREDICTED: *Homo sapiens* similar to Nicotinamide phosphoribosyltransferase (NAmPRTase) (Nampt) (Pre-B cell enhancing factor) (Pre-B-cell colony-enhancing factor 1) (LOC646309) |
| 2 | AA464861 | CREM | cAMP responsive element modulator |
| 3 | AA406552 T97782 | SLC2A3 | solute carrier family 2 (facilitated glucose transporter), member 3 |
| 4 | AA490903 | PSCDBP | pleckstrin homology, Sec7 and coiled-coil domains, binding protein |
| 5 | R45525 | RAB5A | RAB5A, member RAS oncogene family |
| 6 | T62636 | CXCR4 | chemokine (C—X—C motif) receptor 4 |
| 7 | H86558 | MAD | MAX dimerization protein 1 |
| 8 | R80217 AA644211 | PTGS2 | prostaglandin-endoperoxide synthase 2 (prostaglandin G/H synthase and cyclooxygenase) |
| 9 | R92737 | AQP3 | aquaporin 3 |
| 10 | H72122 | ENC | ectodermal-neural cortex (with BTB-like domain) |
| 11 | N39161 | CD36 | CD36 molecule (thrombospondin receptor) |
| 12 | H58254 | CCR2 | chemokine (C-C motif) receptor 2 |
| 13 | AA625806 | NINJ1 | ninjurin 1 |
| 14 | NM_001838 | CCR7 | chemokine (C-C motif) receptor 7 |
| | | | Group 2 |
| 15 | R33852 | STX11 | syntaxin 11 |
| 16 | N45301 | CALCRL | calcitonin receptor-like |
| 17 | N50152 | OTUD1 | OTU domain containing 1 |
| 18 | H23978 | GTF2B | general transcription factor IIB |
| 19 | AA464849 | TXNRD1 | thioredoxin reductase 1 |
| 20 | T97762 | IFRD1 | interferon-related developmental regulator 1 |
| 21 | N64734 | EHHADH | enoyl-Coenzyme A, hydratase/3-hydroxyacyl Coenzyme A dehydrogenase |
| 22 | AA441930 R59062 | PICALM | phosphatidylinositol binding clathrin assembly protein |
| 23 | N70463 | BTG1 | B-cell translocation gene 1, anti-proliferative |
| 24 | AA485683 | ARL4C | ADP-ribosylation factor-like 4C |

TABLE 2-continued

The Genbank accession number as on the microarray, name and Unigene name of the candidate sequences of Table 1. Some names were not available. EST: expressed sequence tag. In the first column the corresponding SEQ ID NO.

| | GENBANK™ Accession number | Name | Name (official UNIGENE™ name) |
|---|---|---|---|
| 25 | AA485226 | VDR | vitamin D (1,25-dihydroxyvitamin D3) receptor |
| 26 | AA424833 | BMP6 | bone morphogenetic protein 6 |
| 27 | AA447797 | PLAT | plasminogen activator, tissue |
| 28 | W73874 | CTSL | cathepsin L |
| 29 | R91570 | STAT4 | signal transducer and activator of transcription 4 |
| 30 | H16746 | CD86 | CD86 molecule |
| 31 | AA425102 | CCL2 | chemokine (C-C motif) ligand 2 |
| 32 | AA011215 | SSAT | spermidine/spermine N1-acetyltransferase 1 |
| 33 | AA017544 | RGS1 | regulator of G-protein signalling 1 |
| 34 | AA057378 | RAB32 | RAB32, member RAS oncogene family |
| 35 | AA088749 | CIDE3 | cell death-inducing DFFA-like effector c |
| 36 | AA099357 | ABCA6 | ATP-binding cassette, sub-family A, member 6 |
| 37 | AA156781 | EMB | embigin homolog |
| 38 | AA258396 | PHLDA1 | pleckstrin homology-like domain, family A, member 1 |
| 39 | AA419177 | SLC7A5 | solute carrier family 7 (cationic amino acid transporter, y+ system), member 5 |
| 40 | AA425692 | UNKNOWN | hypothetical protein |
| 41 | AA449742 | F13A1 | coagulation factor XIII, A1 polypeptide |
| 42 | AA644088 | CTSC | cathepsin C |
| 43 | H56349 | FGL2 | fibrinogen-like 2 |
| 44 | N48178 | PIP3E | phosphoinositide-binding protein PIP3-E |
| 45 | W92764 | TNFAIP6 | tumor necrosis factor, alpha-induced protein 6 |
| | | | Group 3 |
| 46 | AA629687 | NFE2L2 | nuclear factor (erythroid-derived 2)-like 2 |
| 47 | AA458838 | PMAIP1 | phorbol-12-myristate-13-acetate-induced protein 1 |
| 48 | AA633811 | NFIL3R | nuclear factor, interleukin 3 regulated |
| 49 | AA459650 | | PHD finger protein 20-like 1 |
| 50 | AA487070 | PAI-1 | SERPINE1 mRNA binding protein 1 |
| 51 | T97471 | EST | WD repeat- and FYVE domain-containing protein 2 |
| 52 | R92197 | GAL8 | lectin, galactoside-binding, soluble, 8 (galectin 8) |
| 53 | N53214 | | NACHT, leucine rich repeat and PYD containing 2 |
| 54 | N25945 | PLS1 | phospholipid scramblase 1 |
| 55 | AA442780 | HIV EBP1 | human immunodeficiency virus type I enhancer binding protein 1 |
| 56 | AA044814 | | chromosome 10 open reading frame 46 |
| 57 | W33154 | KIAA0554 | formin binding protein 1 |
| 58 | R44078 | MUSK1 | muskelin 1, intracellular mediator containing kelch motifs |
| 59 | R26396 | P21AK3 | p21 (CDKN1A)-activated kinase 3 |
| 60 | AA463642 | SO | sulfite oxidase |
| 61 | H97566 | USP12 | ubiquitin specific peptidase 12 |
| 62 | R06372 | | mitochondrial ribosomal protein L16 |
| 63 | R95913 | LPS SRP | chromosome 14 open reading frame 43 |
| 64 | N29918 | EST | zinc finger and BTB domain containing 10 |
| 65 | N63733 | KIAA0247 | KIAA0247 |
| 66 | AA496359 | IEP3 | immediate early response 2 |
| 67 | N20480 | HSPC 157 | HSPC157 protein |
| 68 | H24308 | EST | UDP-N-acetyl-alpha-D-galactosamine:polypeptide N-acetylgalactosaminyltransferase 1 |
| 69 | H78233 | EST | tetratricopeptide repeat domain 5 |
| 70 | T63342 | EST | EST |
| 71 | R52681 | NUP155 | nucleoporin 155 kDa |
| 72 | T57841 | UFD_L | ubiquitin fusion degradation 1 like (yeast) |
| 73 | AA026682 | | DNA topoisomerase II, alpha isozyme |
| 74 | AA045278 | SART2 | squamous cell carcinoma antigen recognized by T cells 2 |
| 75 | AA052960 | DKC1 | dyskeratosis congenita 1, dyskerin |
| 76 | AA055585 | KLF6 | Kruppel-like factor 6 |
| 77 | AA262212 | DLG7 | discs, large homolog 7 (Drosophila) |

TABLE 2-continued

The Genbank accession number as on the microarray, name and Unigene name of the candidate sequences of Table 1. Some names were not available. EST: expressed sequence tag. In the first column the corresponding SEQ ID NO.

| | GENBANK™ Accession number | Name | Name (official UNIGENE™ name) |
|---|---|---|---|
| 78 | AA280647 | STAT5B | signal transducer and activator of transcription 5B |
| 79 | AA406362 | PTGER3 | prostaglandin E receptor 3 (subtype EP3) |
| 80 | AA416783 | | recombining binding protein suppressor of hairless (*Drosophila*) |
| 81 | AA421300 | ZMYM3 | zinc finger, MYM-type 3 |
| 82 | AA424045 | S100B | S100 calcium binding protein B |
| 83 | AA430625 | DPYD | dihydropyrimidine dehydrogenase |
| 84 | AA431716 | ARHGAP17 | Rho GTPase activating protein 17 |
| 85 | AA436372 | ZBTB17 | zinc finger and BTB domain containing 17 |
| 86 | AA443570 | MAFK | Unknown |
| 87 | AA446013 | RPL27A | ribosomal protein L27a |
| 88 | AA446021 | RBM17 | RNA binding motif protein 17 |
| 89 | AA446027 | EGR2 | early growth response 2 (Krox-20 homolog, *Drosophila*) |
| 90 | AA446462 | BUB1 | BUB1 budding uninhibited by benzimidazoles 1 homolog (yeast) |
| 91 | AA453293 | PDE4B | phosphodiesterase 4B, cAMP-specific (phosphodiesterase E4 dunce homolog, *Drosophila*) |
| 92 | AA454098 | KIF23 | kinesin family member 23 |
| 93 | AA455338 | GYPB | glycophorin B (MNS blood group) |
| 94 | AA457705 | IER3 | immediate early response 3 |
| 95 | AA463631 | SRP72 | signal recognition particle 72 kDa |
| 96 | AA464246 | HLA-B | major histocompatibility complex, class I, C |
| 97 | AA478724 | IGFBP6 | insulin-like growth factor binding protein 6 |
| 98 | AA481397 | PDE4D | phosphodiesterase 4D, cAMP-specific (phosphodiesterase E3 dunce homolog, *Drosophila*) |
| 99 | AA488075 | STAT1 | signal transducer and activator of transcription 1, 91 kDa |
| 100 | AA490996 | PYHIN1 | interferon, gamma-inducible protein 16 |
| 101 | AA496097 | HNRPA3 | heterogeneous nuclear ribonucleoprotein A3 pseudogene 1 |
| 102 | AA496944 | SEPT11 | septin 11 |
| 103 | AA598815 | PSMA5 | proteasome (prosome, macropain) subunit, alpha type, 5 |
| 104 | AA598887 | SMC1A | structural maintenance of chromosomes 1A |
| 105 | AA621150 | SMA3 | baculoviral IAP repeat-containing 1 |
| 106 | AA634109 | FCGR2B | Fc fragment of IgG, low affinity IIa, receptor for (CD32) |
| 107 | AA664219 | NR3C1 | nuclear receptor subfamily 3, group C, member 1 |
| 108 | AA676515 | AZIN1 | antizyme inhibitor 1 |
| 109 | AA723035 | ZFP36L1 | zinc finger protein 36, C3H type-like 1 |
| 110 | H02336 | XTP3TPA | XTP3-transactivated protein A |
| 111 | H08820 | IDI1 | isopentenyl-diphosphate delta isomerase 1 |
| 112 | H16829 | KIAA1414 | KIAA1414 protein |
| 113 | H19203 | PRDX3 | peroxiredoxin 3 |
| 114 | H21107 | BCLAF1 | BCL2-associated transcription factor 1 |
| 115 | H23187 | CA2 | carbonic anhydrase II |
| 116 | H53620 | SERBP1 | SERPINE1 mRNA binding protein 1 |
| 117 | H60298 | LOC129607 | thymidylate kinase family LPS-inducible member |
| 118 | H64347 | SDC2 | syndecan 2 (heparan sulfate proteoglycan 1, cell surface-associated, fibroglycan) |
| 119 | H80685 | C5orf13 | chromosome 5 open reading frame 13 |
| 120 | H96867 | C12orf4 | chromosome 12 open reading frame 4 |
| 121 | N30868 | CERKL | integrin alpha 4 precursor |
| 122 | N33274 | PAICS | phosphoribosylaminoimidazole carboxylase, phosphoribosylaminoimidazole succinocarboxamide synthetase |
| 123 | N34799 | FOSL2 | FOS-like antigen 2 |
| 124 | N62522 | SLAMF8 | SLAM family member 8 |
| 125 | N63866 | ABHD10 | abhydrolase domain containing 10 |
| 126 | N63988 | IFIT2 | interferon-induced protein with tetratricopeptide repeats 2 |
| 127 | R07749 | CPNE3 | cyclic nucleotide gated channel beta 3 |
| 128 | R22788 | | Unknown |

TABLE 2-continued

The Genbank accession number as on the microarray, name and Unigene name of the candidate sequences of Table 1. Some names were not available. EST: expressed sequence tag. In the first column the corresponding SEQ ID NO.

| | GENBANK™ Accession number | Name | Name (official UNIGENE™ name) |
|---|---|---|---|
| 129 | R26536 | | Unknown |
| 130 | R42433 | | Unknown |
| 131 | R56219 | CDH8 | cadherin 8, type 2 |
| 132 | R69277 | SNX9 | sorting nexin 9 |
| 133 | R70784 | MCTS1 | malignant T cell amplified sequence 1 |
| 134 | R83270 | TGIF | TGFB-induced factor (TALE family homeobox) |
| 135 | R93912 | GSK3B | glycogen synthase kinase 3 beta |
| 136 | T62849 | MS4A7 | membrane-spanning 4-domains, subfamily A, member 7 |
| 137 | W32409 | SLC16A10 | solute carrier family 16, member 10 (aromatic amino acid transporter) |
| 138 | W37372 | | Unknown |
| 139 | W44762 | KCNJ2 | potassium inwardly-rectifying channel, subfamily J, member 2 |
| 140 | W72666 | | mitochondrial ribosomal protein S6 |
| 141 | W86100 | MYB | v-myb myeloblastosis viral oncogene homolog (avian) |
| 142 | W87741 | MYC | v-myc myelocytomatosis viral oncogene homolog (avian) |
| 143 | W42723 | CXCL1 | chemokine (C—X—C motif) ligand 1 (melanoma growth stimulating activity, alpha) |
| 144 | AA677522 | CCL3 | chemokine (C-C motif) ligand 3 |
| 145 | AA036881 | CCR1 | chemokine (C-C motif) receptor 1 |
| 146 | AA120816 | MRPL35 | mitochondrial ribosomal protein L35 |
| 147 | AA425302 | MAGEF1 | melanoma antigen family F, 1 |
| 148 | AA431199 | ZCD1 | zinc finger, CDGSH-type domain 1 |
| 149 | AA431203 | DNAJB6 | DnaJ (Hsp40) homolog, subfamily B, member 6 |
| 150 | AA488609 | NUP88 | nucleoporin 88 kDa |
| 151 | AA703058 | MPO | myeloperoxidase |
| 152 | N59136 | FBXO9 | F-box protein 9 |
| 153 | N74380 | ZFYVE26 | zinc finger, FYVE domain containing 26 |

BIBLIOGRAPHIC REFERENCES

The use of basal cytotoxicity and target organ toxicity tests in hazard identification and risk assessment. Balls M. and Fentem J. H., ATLA (1992) 20: 368-388.

Rapid Method for identification of the cellular target of xenobiotics. Vander Plaetse F. and Schoeters G. Clin. Chemistry (1995) 41: 1906-1908.

Rapid colorimetric assay for cellular growth and survival: application to proliferation and cytotoxicity assays. Mosmann T., J. Immunol. Methods (1983) 65: 55-63.

A new rapid and simple non-radioactive assay to monitor and determine the proliferation of lymphocytes: an alternative to [3H]thymidine incorporation assay. Ahmed S A, Gogal R M Jr, Walsh J E, J. Immunol. Methods (1994) 170: 211-224.

An enzyme-release assay for natural cytotoxicity. Korzeniewski C, Callewaert D M. J. Immunol. Methods (1983) 64:313-320.

Flow cytometry evaluation of cell-mediated cytotoxicity. Zarcone D, Tilden A B, Cloud G, Friedman H M, Landay A, Grossi C E. J Immunol Methods (1986) 94:247-255.

SEQUENCE LISTING (154 sequences)

SEQ ID NO: 1 - DNA, 4593 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaaaaaaaaaaaaa

SEQ ID NO: 2 - DNA, 2225 bp, Homo sapiens
gacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaaaaaa

SEQ ID NO: 3 - DNA, 3915 bp, Homo sapiens
gtggggtggggtggggctgggggcttgtcgccctttcaggctccaccctttgcggagattataaatagtcatgatcccagcgagacccagagatgcctgtaatggtgagactttggatccttcctgaggacgtggagaaaactttctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataatttttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttccttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcgagtgtgctttagcttgaaaaggtgaccttgcaacttcatgtcaactttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 4 - DNA, 2282 bp, Homo sapiens
gttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcatgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaaaaaaaaaaaaaaaaaaaaaaaaaaaaaaaaaaaaaaaaaaaaaaaaaaaaaaaaaaaaaaaaaaaaaaaaaa

SEQ ID NO: 5 - DNA, 2352 bp, Homo sapiens
gccattaccaatcgcgaaaccgcgccggcggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggtt

SEQ ID NO: 6 - DNA, 1912 bp, Homo sapiens
ttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaaa

SEQ ID NO: 7 - DNA, 5587 bp, Homo sapiens
gagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaagaaa

SEQ ID NO: 8 - DNA, 4465 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtcttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactattta

SEQ ID NO: 9 - DNA, 1835 bp, Homo sapiens
ctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaaaaaaaaaaaaa

SEQ ID NO: 10 - DNA, 4827 bp, Homo sapiens
gcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaagtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggctggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcatgtatcacagatgtaaattaactcaccagatttactgggcctgaactcattctcttcttgctatatgatttagcaagttctagaaggtctccaagacaataattacattggcacaatgtatacttcagtgctcacccgtagcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacatataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcaaaaaaaaaaaaaaaaaaaaaaaaaaaaaaaaaaaaaaaaaaa

SEQ ID NO: 11 - DNA, 2338 bp, Homo sapiens
gaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaaaaa

SEQ ID NO: 12 - DNA, 2562 bp, Homo sapiens
agaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagatttaaaaa

SEQ ID NO: 13 - DNA, 1309 bp, Homo sapiens
cgcagctggagcctgcggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcaaaaaaaaaaaaaaaaaaaaaaaaaaaaaaaaaaaaa

SEQ ID NO: 14 - DNA, 2188 bp, Homo sapiens
agacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaa

SEQ ID NO: 15 - DNA, 1970 bp, Homo sapiens
ggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaaaaaaaaaaaaaaaaaaaaaaaaaaaaaaaaaaaaaaaaaaaaaaaaaaaaaaaa

SEQ ID NO: 16 - DNA, 3008 bp, Homo sapiens
gatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgcta

SEQ ID NO: 17 - DNA, 3389 bp, Homo sapiens
atgccggaagctttcctgccacgcaagctttccgagcatgctaactcgccccaagcagctcccatcccgcagcatccactgcagccgctgaggagagtggcgcagcgcagaaaccagtgcccagtgcccaggtgggggaagcggtccgtgggagtcactccccagcggccgccgcgggccgaagcagctgcagcgggcgcggcgccccgggtctgcgggccgagcgcaccggcaggggtcgagctcgcgtcccgtccccgcccccctgcgctgtggcgcagcaggaatttggccgggacccgggcgctattcgcggctgctgactcgcggcggccggctgcctttcgctcatctctattctggggccgttgggtcaccgcgctccgccggccccctcccccgggcccggagggtgtgtcccccgctccggggctcgccgcgcctataaggggccgagcggcgggcagggacatgcagctctacagcagcgtctgcacccactaccccgccggggccccgggtcccacggccgccgcccccgcgccacccgccgccgctacccccttcaaggtctcgctgcagcccccgggagccgccggcgccgcgcccgagcccgagaccggtgagtgccagcccgccgcggccgccgagcaccgggaagccgccgctgtccccgccgccaagatgcccgccttctcctcctgcttcgaggtggtgtccggggccgccgcgcccgcctccgccgccgccggcccgcccggcgcgtcctgcaagccgccgctgccgccgcactacacgtccaccgcacagatcaccgtgcgggccctgggcgccgacaggctcctgctgcacgggcccgatcccgttcccggcgccgcgggctccgccgctgccccgcgcggccgctgcctcctgctcgccccggcgcccgcagccccggtcccgccgcggcggggctcctcggcctggctcctggaggagctgctgcggcccgactgccccgagcccgcgggcttggacgcgacacgggaggggcccgatcggaacttccgactgagcgagcaccgccaggccctggccgccgccaagcaccgaggccccgcggcgaccccggggagccccgatcccggccccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatctcgaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcacaacatttttaaaaactggtgtaccttcatctatgacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtttggcccattccattttgatgaaacagagctgttgttttggaagtcattatttttctagaaatggcgaatcttttaaagaaaattacttaatggaaggttgtgggaaggtgtttttttgtgttttttttttggtttttgttttgtttttcctcttttaagggatagtagcaggtcttacttgaatgaaagtctgatatttgctgatggcagaatgattattctgtaccctggttgatgtgtagagtagattgtctggtgctctcagttgtttttatttacatttgtcacgttgttgtaagagaatgttaacatggtataaaactctgtgacaagataagcctcctgctttatataacttcttgaatccagctaagagatttataaactaatggcataaatgtctggagccaaccttggcagttatagcaggagaacactgtcttaatatttctttacattctttcaaaaggcaaaataggattgccctgtattgatgtagaaatgtctgtaaacagagcttgtatggtttgctgggtcaaacaatgtttccaacttaaaatcaatctcattgccactttaactacttttagtcatatttattaagtaatgcagtttgtactttttttattttgtaacattttgtgatttttttgtacaaaactgtatttgtacaatagagcaattcccagctgatggaatgaatgaataaaatgcaaaattatacttttacaatgcctttttggatagagtggtttttaaattgtgatgtttgtaggaaactttcttgcatgtatgcatgtacacaattttttttttccataaagatgccacagcaatagagaggtttcctaaattatcacatgaagaggataggctaatcatgagtaatttcaaaggataagtctgaataaaatataatttaaaagtg

SEQ ID NO: 18 - DNA, 1304 bp, Homo sapiens
cttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaa

SEQ ID NO: 19 - DNA, 3923 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 20 - DNA, 2273 bp, Homo sapiens
gccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaaaaaaaaa

SEQ ID NO: 21 - DNA, 3821 bp, Homo sapiens
agaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaaaaaaaaaaaaaaaaaaaaaa

SEQ ID NO: 22 - DNA, 3860 bp, Homo sapiens
cctgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgaaaaaaaaaaaa

SEQ ID NO: 23 - DNA, 1783 bp, Homo sapiens
cctctcggagctggaaatgcagctattgagatcttcgaatgctgcggagctggaggcggaggcagctggggaggtccgagcgatgtgaccaggccgccatcgctcgtctcttcctctctcctgccgcctcctgtgtcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagcgccccgggccgcccccgcacgccgcccccatgcatcccttctacacccgggccgccaccatgataggcgagatcgccgccgccgtgtccttcatctccaagtttctccgcaccaaggggctgacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatccataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatttttaacc

SEQ ID NO: 24 - DNA, 4024 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaaaaaaaaaaaaaaaaa

SEQ ID NO: 25 - DNA, 4669 bp, Homo sapiens
ctgcttgtcaaaaggcggcagcggagccgtgtgcgccgggagcgcggaacagcttgtccacccgccggccggaccagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaaaaaaaaaaaaaaaaaa

SEQ ID NO: 26 - DNA, 2943 bp, Homo sapiens
gcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggagtccacgtccacccccgagccgcaggcctggtgggcagagacggcccttacgataagcagcccttcatggtggctttcttcaaagtgagtgaggtccacgtgcgcaccaccaggtcagcctccagccggcgccgacaacagagtcgtaatcgctctacccagtcccaggacgtggcgcgggtctccagtgcttcagattacaacagcagtgaattgaaaacagcctgcaggaagcatgagctgtatgtgagtttccaagacctgggatggcaggactggatcattgcacccaagggctatgctgccaattactgtgatggagaatgctccttcccactcaacgcacacatgaatgcaaccaaccacgcgattgtgcagaccttggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtgggacgatgagactttgaaactatctcatgccagtgccttattacccaggaagattttaaaggacctcattaataatttgctcacttggtaaatgacgtgagtagttgttggtctgtagcaagctgagtttggatgtctgtagcataaggtctggtaactgcagaaacataaccgtgaagctcttcctaccctcctcccccaaaaacccaccaaaattagttttagctgtagatcaagctatttggggtgtttgttagtaaatagggaaaataatctcaaaggagttaaatgtattcttggctaaaggatcagctggttcagtactgtctatcaaaggtagattttacagagaacagaaatcggggaagtggggggaacgcctctgttcagttcattcccagaagtccacaggacgcacagcccaggccacagccagggctccacggggcgcccttgtctcagtcattgctgttgtatgttcgtgctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcagtgctcacctcttctttaccagaacggttctttgaccagcacattaacttctggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttccctgtagaaagtgaggctcagattaaattttagaatattttctaaatgtctttttcacaatcatgtgactgggaaggcaatttcatactaaactgattaaataatacatttataatctacaactgtttgcacttacagctttttttgtaaatataaactataatttattgtctattttatatctgttttgctgtggcgttggggggggggccgggcttttgggggggggggtttgtttggggggtgtcgtggtgtgggcgggcgg

SEQ ID NO: 27 - DNA, 2653 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 28 - DNA, 1632 bp, Homo sapiens
gccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgta

SEQ ID NO: 29 - DNA, 2761 bp, Homo sapiens
agaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 30 - DNA, 2784 bp, Homo sapiens
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcaaaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 760 bp, Homo sapiens
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaa

SEQ ID NO: 32 - DNA, 1683 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggtttaggagagcaccccttttaccactgcctggttgcagaagtgccgaaagagcactggactccggaaggacacagcattgtggtatagccatgtactatattacctatgacccgtggattggcagctatcgtatcttggaggacttcttcgtgatgagtgacttatagaggctttggcataccgatcagaaattctgaaagaatctaaggccaggttgcaatgaggtggtcgctggacgccgcctgcaccttctgggtagcagcaatgggatgcagccattccctcaacgttcttattcaacgaagacggggctcagaaaccggccagcgacagagggttgagacggtcaagactcgacaggggttctgcaaacaagtgcacacgagagtaggaggccgctgtgataaccctctcattcgagaaatccacactcgactacatcgtgtgcgagaaaatatgcgcccagtttcacgggcgcgtatagactgcaagacacaagcaagcaccatttaccggcgcttgtttccgcgtcgacatactctgagacggaagcagacacgacgaacgagatcgcagaagcgaaagagccacaggccagccagcagcagagcagcaaggcgggtacacgtcgccaacgacaaggccgggatgcgcagagcagtcggagggaagcagggggatgaagcagacaacgagaacgaaagcagacaacacaacgctaccgagaggacgagaagcagagaaatggaaggcacagtgagaggaagcgagcagcgcgagaagactgacaagagagcgagagagaagcagacagacgacggagccgcgaccggacgccggagcgagcgaaggccacagcgggcgagctagagcagaagacaggacgaccagcgagaaggaaggagaagcggggaagagagcaggagagggagcacgagggacgaacgggaggagcgacgggggagacaagacggagcgagccgcggcaggggagggcgagcgcaggaatagaagagaagaagagagaacaacaacgaggcggagagaggagagcgaggaacagacgcgtgggacgggaagagggcgcacacgggaagggaggcgaagagggagacgcaaggggcgagaggcgagaggaacgcaagcagaaggaagagcggagagagcgaggaggaacagacacgagacgcgctgggagagcgagacaggcgaaggagggaaggagagaggcgagtaagagaggcaggagacgtagagaacaggagggcgcgacgcccacggggagagggagggcaggagagagaaggaagcacggcgaggaacgggaggaacgaacgacgagcggggcagcgggcgaggacgaggaggg

SEQ ID NO: 33 - DNA, 1403 bp, Homo sapiens
gcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaagattc

SEQ ID NO: 34 - DNA, 2630 bp, Homo sapiens
gtatgcatcttttgctttctagctcatatttctgagctgtgaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctgttgggtgatttgctctacttgccagctttgctgtaaaaagaaaaaaaaaaaaaaaaaggggcagtaagtataactgcttatgcgagtgtgcattttggtggaggagttttataaatgatagacaaaattcccctttaggctctatttaatctttcagatagtaaatccagatttgcccccagatgtaagacgtcatgtgactagtagcttgtgactgtgtaagtcatcggtttcactttatgtatggataggattacacgcagaggtgaaaggtgaaacgctggttaagagtacaagtttcaagtttgctctgtgcttccatacaaatataatagaagcagcttctgtagaatttccttagcagtaaaccagacgtgttccaagagaataacagtaataaaaaaatttaggttaaaaatcttagagttaaggcttaaagtactgcctaaatgtcactaaggtacacttctgagctggcctgcagctaacttcagatctgacttttgcttgaattgcagtcatccgaatttcactaggaacataggcaaaagataacttttgcaaataaatttcatcatttcacctttatggcaaataatggatttctaatatgaaactttaataatattaacatatgggaattacattaacatgtgactagttacactatcattggaattttaaccaactgcttccaaatacagttagagaattttataattatttgatataatggggatagctgggactgaatgtcactcggacattcaaaagatcaatacttgaattaaagttaacacttatcttgggagtggaggtaaaaaaaaaaaaaaaaa

SEQ ID NO: 35 - DNA, 1305 bp, Homo sapiens
agaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgaaaaaaaaaaaaaaaaaaaaaaaaaaaaa

SEQ ID NO: 36 - DNA, 5296 bp, Homo sapiens
ctgctggagtaggcacccatttaaagaaaaaatgaagaagcagcaataaagaagttgtaatcgttacctagacaaacagagaactggttttgacagtgtttctagagtgctttttattattttcctgacagttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcagctcattgctgggatggatatggtgagttttcatgtacattgaccaaatactggaatagaggatttgtggctttacaaacagctattaatactgccattatagaaatcacaaccaatcaccctgtgatggaggagttgatgtcagttactgctataactatgaagacattacctttcataactaaaaatcttcttcacaatgagatgtttattttattcttcttgcttcatttctccccacttgtatattttatatcactcaatgtaacaaaagagagaaaaaagtctaagaatttgatgaaaatgatgggtctccaagattcagcattctggctctcctggggtctaatctatgctggcttcatctttattatttccatattcgttacaattatcataacattcacccaaattatagtcatgactggcttcatggtcatatttatactcttttttttatatggcttatctttggtagctttggtgttcctgatgagtgtgctgttaaagaaagctgtcctcaccaatttggttgtgtttctccttaccctcttttggggatgtctgggattcactgtattttatgaacaacttccttcatctctggagtggattttgaatatttgtagcccttttgcctttactactggaatgattcagattatcaaactggattataacttgaatggtgtaatttttcctgacccttcaggagactcatatacaatgatagcaactttttctatgttgcttttggatggtctcatctacttgctattggcattatactttgacaaaattttaccctatggagatgagcgccattattctcctttatttttcttgaattcatcatcttgtttccaacaccaaaggactaatgctaaggttattgagaaagaaatcgatgctgagcatccctctgatgattattttgaaccagtagctcctgaattccaaggaaaagaagccatcagaatcagaaatgttaagaaggaatataaaggaaaatctggaaaagtggaagcattgaaaggcttgctctttgacatatatgaaggtcaaatcacggcaatcctgggtcacagtggagctggcaaatcttcactgctaaatattcttaatggattgtctgttccaacagaaggatcagttaccatctataataaaaatctctctgaaatgcaagacttggaggaaatcagaaagataactggcgtctgtcctcaattcaatgttcaatttgacatactcaccgtgaaggaaaacctcagcctgtttgctaaaataaaagggattcatctaaaggaagtggaacaagaggtacaacgaatattattggaattggacatgcaaaacattcaagataaccttgctaaacatttaagtgaaggacagaaaagaaagctgacttttgggattaccattttaggagatcctcaaattttgcttttagatgaaccaactactggattggatcccttttccagagatcaagtgtggagcctcctgagagagcgtagagcagatcatgtgatccttttcagtacccagtccatggatgaggctgacatcctggctgatagaaaagtgatcatgtccaatgggagactgaagtgtgcaggttcttctatgtttttgaaaagaaggtggggtcttggatatcacctaagtttacataggaatgaaatatgtaacccagaacaaataacatccttcattactcatcacatccccgatgctaaattaaaaacagaaaacaaagaaaagcttgtatatactttgccactggaaaggacaaatacatttccagatcttttcagtgatctggataagtgttctgaccagggagtgacaggttatgacatttccatgtcaactctaaatgaagtctttatgaaactggaaggacagtcaactatcgaacaagatttcgaacaagtggagatgataagagactcagaaagcctcaatgaaatggagctggctcactcttccttctctgaaatgcagacagctgtgagtgacatgggcctctggagaatgcaagtctttgccatggcacggctccgtttcttaaagttaaaacgtcaaactaaagtgttattgaccctattattggtatttggaatcgcaatattccctttgattgttgaaaatataatgtatgctatgttaaatgaaaagatcgattgggaatttaaaaacgaattgtattttctctctcctggacaacttccccaggaaccccgtaccagcctgttgatcatcaataacacagaatcaaatattgaagattttataaaatcactgaagcatcaaaatatacttttggaagtagatgactttgaaaacagaaatggtactgatggcctctcatacaatggagctatcatagtttctggtaaacaaaaggattatagattttcagttgtgtgtaataccaagagattgcactgttttccaattcttatgaatattatcagcaatgggctacttcaaatgtttaatcacacacaacatattcgaattgagtcaagcccatttcctcttagccacataggactctggactgggttgccggatggttcctttttcttatttttggttctatgtagcatttctccttatatcaccatgggcagcatcagtgattacaagaaaaatgctaagtcccagctatggatttcaggcctctacacttctgcttactggtgtgggcaggcactagtggacgtcagcttcttcattttaattctccttttaatgtatttaattttctacatagaaaacatgcagtaccttcttattacaagccaaattgtgtttgctttggttatagttactcctggttatgcagcttctcttgtcttcttcatatatatgatatcatttatttttcgcaaaaggagaaaaaacagtggcctttggtcattttacttcttttttgcctccaccatcatgttttccatcactttaatcaatcattttgacctaagtatattgattaccaccatggtattggttccttcatataccttgcttggatttaaaacttttttggaagtgagagaccaggagcactacagagaatttccagaggcaaattttgaattgagtgccactgattttctagtctgcttcataccctactttcagactttgctattcgtttttgttctaagatgcatggaactaaaatgtggaaagaaaagaatgcgaaaagatcctgttttcagaatttccccccaaagtagagatgctaagccaaatccagaagaacccatagatgaagatgaagatattcaaacagaaagaataagaacagccactgctctgaccacttcaatcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcatagaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgatgaagaaattgatacaacaatgagatggaaactcctccctcattcagatgaaccttaaaacctcaaacctagtaattttttgttgatctcctataaactcatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaactt

SEQ ID NO: 37 - DNA, 1846 bp, Homo sapiens
gcataactgatggagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttatttttttaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaaaaaaaaaaaaaa

SEQ ID NO: 38 - DNA, 5913 bp, Homo sapiens
gtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 39 - DNA, 4543 bp, Homo sapiens
cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 40 - DNA, 1442 bp, Homo sapiens
acatacttttgaaggatgtgcaacgttcaatgataagtgtgacaaaaactgacaaccaggaagcttgtgtactcagtgagagtagcatgtttgtctccaagaaacgtttcattttgaagacacgtggtaccactctcttactgaaagcgctggttcccctgttgaagcttgctaggcattacagtgggtttgactcaattcaaagcttcttttattcttgtgagaatttcatgaagccttccccctaagggtacctacactagaatttccaggaagaaatagagtttcttaatgcaattttcccaaatggagcagcatattgtatgggaagtatgaattctgactgttggtacttacgtactctggatttcccagaaaggtaatcagtcagccagatcaaaccctggaaaatttgatgagtgggcttgacccagcagttatggaccagttctacatgaaagatggcgttactgcaaaggatgtcatttgtgagagtggaattcacaacctgataccaggttctgtcattaatgccacaatgttcaatccttatgggtattcgatgaatggaatgaaatcagatggaacttattggactattcacatcactccagaaccagaatctttttatgttagctttgaaacaaacttaagccacctcctatgatgacctgatcaggaaagctatggaaggcttcaagccaggaaaatttgtgatcactttgttaatcagagttctaaatgtcgcgccgtgttttcttcacctcagaagattgaaggttttaagcgtcttgattgccagagtgctatgttcaatgattacaattttgtttttaccagttttgctaagaagcagcaataacagcagagttgattaagaaaaatgaagaaaaaaatgcaaaaagagaacacacgtaagaaggtggtggatgctttctagatgtcgatgctggggtcagtgctttccataaccaccacagtgtagttgcataaagccctatatgtaatgatagtgtaatcattttgaattgtatgcattattatatcaaggaaatagatatcttgcacgaatgttcgcttctgtgtttaggtattctctgccactcttgctgtgaaattgaagtgcatgtagaaaaaaccttttactatatgaaactttataacacttgtgaaagcaattcaatttggtttatgcacagtgtaatatttctccaagtatcatccaaaattccccacagacaaagctttcatcctcattaggtgttggactcagcctaaccgtctaggactgttctattaaattgctgccagaattttacatccagttacctccactttctagaacatattctttactaatattattgaaaccaatttctacctcatacagaggttttttaaaacagcaattaaagtttttcttccatgaaaaaaaaaaaaaa

SEQ ID NO: 41 - DNA, 3833 bp, Homo sapiens
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacctcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagagttcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttcagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatacttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcaccattttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctgagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattat

SEQ ID NO: 42 - DNA, 1904 bp, Homo sapiens
agctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 43 - DNA, 4268 bp, Homo sapiens
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgcattttaaaggagtcctttgttgttatgctgttatccaatgaacacttgcaagcaattagcaatattgagaattatacattagatttacaattcttttaatttctattgaaactttttctattgcttgtattacttgctgtatttaaaaaataattgttggctgggtgtggtagctcacgcctgtaatcccagcactttggaatgtcaaggcaggcagatcacttgaggtcaggagtttgagaccagcctggccaaacatgtgaaacgctgtctctattaaaaatacaaaaattagccgggcatggtggtacatgcctgtaatcctagctacttgggaggctgaggcaggagaatcgcttgaacctgagaggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataa

SEQ ID NO: 44 - DNA, 6687 bp, Homo sapiens
gtttaagtagaatcctcaagcttggcctcagagtactatgaggcttctgaatccaggaataagactgctcttggatttactctctttgtattgcatgtcaaaggcaacagaactggaccaagaaaattcataactttttgtttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgttt

SEQ ID NO: 45 - DNA, 1440 bp, Homo sapiens
cagtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacaaaaaaaaaaaaaaaaaa

SEQ ID NO: 46 - DNA, 2439 bp, Homo sapiens
gcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaaaaaaaaaaaaaaaaaaaaaaaaaaaaaaaaa

SEQ ID NO: 47 - DNA, 1885 bp, Homo sapiens
cgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtcgctgagtgggcggcggcaccggcggagatgcctgggaagaaggcgcgcaagaacgctcaaccgagccccgcgcgggctccagcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaaggtagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaagaagttaatttttaattgatgtttttgaaacttagtagaacaaatattcagaagtaacttgataagatatgaatgtttctaaagagtttctaaaggttcgaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagttcattttttttatctgggctatatacagtcctcaaataaataatgtcttgattttatttcagcaggaataattttatttattttgcctatttataattaaagtatttttctttagtttgaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagattttttttttcagcctagaggcagctattttaccatctggtatttatggtctaatttgtatttaaacatatgcacacatataaaagttgatactgtggcagtaaactattaaaagttttcactgtt

SEQ ID NO: 48 - DNA, 2104 bp, Homo sapiens
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaaaaaaaaaaaaaaaaaaaaa

SEQ ID NO: 49 - DNA, 5454 bp, Homo sapiens
gctgacgtcgccggggcccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgcaaaacagtcagaaatttttattgccttttgagattctccaacttgacaaatgtgccaaagatcaacagacagaaaatatcatcctgtgtatttacttgtcatactttaactttgtgaaagatcttactgataaatgaaaagctttagcagaggtggtattgtggggtaattgcttaaatttacatatcaaagtaaaaaagtagtgcctgtaaaaaaaaaaaaaaaaaa

SEQ ID NO: 50 - DNA, 6764 bp, Homo sapiens
cggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctgattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgatacatatttgaactggaccatagtaattaaatgatttatcaatatcatttgcaagataattgtcaggttgagttaatagtaagtggcagcttcccagaaatttgggttatttggcctaagctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgggggtgtgtgtgtgtgtgtgtgtgtgtgtgtgtgtgtccgtgtccctgagttaagaatggtttttaggcttgtataggattaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatagcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatctttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaa

SEQ ID NO: 51 - DNA, 1629 bp, Homo sapiens
gaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaaaaaaaaaaaaaaaaaa

SEQ ID NO: 52 - DNA, 20915 bp, Homo sapiens
ctgcagactggactggtccacggcaggtggatgccatgtcttgaagacccacaggcacccactcatcctcatgatcatgcagttctctggtttctaacagtgcagtctgggttgcagtctgggagtccagcagagaagagcaggccctggaatcccaggtgtgggggcgtggcttaacgtggagtttccttcagaggcagtgagtgcttgtcattgtctccgtcagcattggctttgggcctagtgtggcctcgaaccttctgttgggatcagcagtggaacagtaggaaaaggaatgagtagacatggcattgcaacaagtctttttttttttttccggtagaattatcatattaagcagaagttttgcttcacaaactctcagccaaatacaaaatactatgaatagtatttaccttgtgtctctttccaaagaactcatagtggtttgcagctattgcagatatcctggccatgcggtatgcggttccttttttttgttttttttttttttttgagacggagccttgctctgtcgcccaggctggagcatagtggcgcgatctcggctcactgcaagctccgcctcccgggttcgtgccattctcctgcctcagcctcccgagtagctgggactacaggcgcccgccaccacacccggctaatttttgtatttttagtagagacggggtttcaccgtgttagccaggatggtctcgatctcctgacctcgtgatcctcctgcctcggcctcccaaagtgctgggattacaggcgtgagcaccgcgcccggccgcagttcctttttatagctgtttgaataggaaagatgacttggaaaatgctggattctgagatttatgtgcagccttaaaaagtgtagtttttctctatcaataatgagtgtgggttgtaattgcttagtaagtaattttgtttatgtaaacgtacatttgttaaattttttttcttaggtaatcccgtatgttggcaccattcccgatcagctggatcctggaactttgattgtgatatgtgggcatgttcctagtgacgcagacaggtaaaatcactgtgctaaaggaaggagcatgaataggctgtctttttgtgattgtggaatgataacagagtaaggcgggagagaccatttgatactctgaggcccaattagctttcatcagcagccctggccaaggtgctgaggagattggaatgaatgactaaataaaggttattgggatttatttcattgctgtaagtctgatttcagtataaaaaaattagaactatcagctggatgtggtgacttacacatacttttccagcactttgggaggccaaggcgggaggattgtttgaggccaggagttcgagaccagcctgggcaacatagtgagacccccccccatctgttaaaaaaaaaaaaaaaaattaaaaattaactgggcttggtggtgtgcgcctgtagttgtagctactcagggggctgaggtaggaggatccttgagccaggagtttgaggttgcagtgagctgtgatggagccactgcactatagcctgggtgacaaaaaaaaaaaaaaaaaaaaaaaaaaaaaaagaaagaaaaagaattaggtatgtcattaaagaaaggaattgtggtcagatgacagggagagtctagttttagtctgacattcccacagcatcacagatctagttcagatggttttactgaatacttgctttggatacaagctgtggtatcattagtgttgggctcagctctgtgtacctaacacctgaagagcagtggtttaagatgtgaaaattaagtctcaaggagacagcccaggccttttcagttaactccttcaagtcgttagagaagtagactccttccagcttaccactctgctatcttgagggtgaggtgaggtcccctttcccattatccttggcagctagatttccagccctcacttctgtgctttgggtagctggatgggtgcatgtggtgtttgcggggaaacagagctggacaaaaggcaagtgcttgctgacttttaaggcagtttctagtagccttccctgagcacttcacttccatcttatcagcagagctttagctgcacaggcaggcctagctgcgagggaggctgggaaaggtaggtttttattctgggcagattcagacccagttcaaactcaggggctattttactgaggaagacagaaaagattagacagtcagctctttaggcctcatagtgaatgaatgaggagggattggtcagtcccttgtcactgggcctggagtgtagtgcctgctgggcctttactggtggctttcctttctgagcactcatgaggcccctgtgtcttccctcatatagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtaggttttggagagggacaggttgagtcctcattagtgagcaggagtgcacaggggggcctttcacatttgtgagcccagccttgtatttcctacacctgagatatagtttggctttgtagtctttctccataaaaggagccaggaaggcacctaaaatatgagggggtggcaccactactctccagccagttgttgccatgcagaaatatggtccactgtgactagatctttttattagatcctatttctcctagcagggctgagttctgaattgacacagtattatgttcatgatgggagggtaagttataatataaccgtcaccacctgaagaactaacaagggcaatcccagcatagaaatcagaagggttttgtaaattcaagtcttgccacaagacagttctgtaggatcatgagatttttagacccagaggacatcctagaaatccttgatgtcagttccatctctggcttcatggagtgtcttatacctagcgcgcgtgtgtatggttgaatttggtcccagaagctcttacacctgctggccctctggcctgtggagctttcccacagtagaggtttgtaccaacgtgagagaagactcacatgcctctggcacagatcctttctgatcttcgggatactgctcctgcccgaaagtctttctgaatctcccaaactccattcacctctcccttctctggccttttgagcccgtgtctgtatcattctttttcacagtttttaacagttgtgctttggctttatgtgtttattttgcctccacaatgggatttaaagctccttgagtcagagactatattgtatgctgctcgcgttttctgcctataacctaacgtggtacctggcatttgagagggagggagggaggaggctcgtagcgtgccgaggacctgcagaagctactttctcgtcatcttactgtagtctgttgaggtagagattgttcctacttcagaataagaaaaccgaattcaaatatgttgggtaacttgtccatattaatttatttagcaaatacaacagattttgagtgtctgccacatgggtggtctccagggacagtgttgtggggagctcgcaggcagatctttaacctgggttcacaatctccagggcacctgtgcctgggcttccaggcgaccttcgaacccagatgtctcacatgtatgcagaggcgcacacaagcacacgcacatatacttatgactgcctgtttgtctggggagagacagttcctggtgcttaatcaaatcaggaactcaaaagaagttcggaagcactgctggtgttttgggtgctttcggttaccatttggtcacgtgtgtggagacctgtgggaacaggtataaaattggacgcaaggaaacatttaaatttggataataagttaatttattaactgtttttttttggtggcgggggggctctgtcttctgtatctctctaggtggctgtaaatggaaaacatactctgctctatggccacaggatcggcccagagaaaatagacactctgggcatttatggcaaagtgaatattcactcaattggttttagcttcagctcggtgagtgaccttccacagcttggggtcttttatgaggatggtttctgatgagatggtagaaaaaatcttcaaataacacttctattgacataaaaaggacgtatctccctgactgtagtattaattttttggaagtgaactgttcacactagcagaaggctgtttatcagccagggcttcattgtctgtaggatctcaaacctagtgtggttttaataaaacacacacagtttttagctgggtagcagctatttcctttgcatgggcataaaatggagtatttctgtaagacaggttcctaggctgggagtgtctgagtcaaagagcacagtcatgtgttgcataaggacagttcagtcaaagatgaaccgcatatacaaccgtggtcccataagattgtcatatactgtatttttaccataccttttctatgtttaggtaagtttatatgcacaaatacttaccatcctgctctggttgcctacagtatttggtacagtgcctgctgtacagattcactggccaggagctataggccacaccctacagcctaggtgtgtagttggcagtaccatctaaggttgttaagtaatattctgtgatgtttgcacgatgacaaaagtcatgtaaggacacatttctcagaacatacccccttcgttaagcaacacatgactgtctttgcattgaaaattttgatagatactaactcgcccttcacaagggtaaaaacagtttgcactctcaacagccatgctcccaccttcttgttgacattacatcttattctctgtaatgtttgccaatctgatggggggcggaaaggacccccagtgtcaagtatatttttggatcatagttttcaagcatatttttagtaccatttataatttttttatatgtcaaacaggttatatatagaaaatattttctactggatgttacaaattaatctttattatcttttctcaggacttacaaagtacccaagcatctagtctggaactgacagagataagtagagaaaatgtaaatattaaatcttttaatgagccactggtttaaaaatgttgttttagctgccatgttaatgaaatggcaagaaggctgggtttttgaaaattatgcttttagaacgcaagtaatcacttgaaaattgagatacatacttgtggtgccaggcacgcagtaagtttttgctgatgattcacctgtcagtttctgtaactgccactcactgttcttatgtaaaaagcactctctcactcttaactgctgaatagtactgttctggggtatttccaaatattgaacatcagccagtgcactggcaaatgaacttccatgtgtatcttcaacccctgggagaataactgcaatttaaaaatgcgctgttattaatggagaaagtgaggtcttaccgactggcacgttcacacctcacagacagaatagaatcttagcattctgggggcaccctggaaaggacaactaagacacgtttgaagttcatgtagtgctgggtgaaggtggtggctcaggcctgtagtcccagcgctttggctgaggtggggggattgcttgagcctaggagtttgagatcagcctgggccacatagggagaaccccatctctacaaaaaattaaaaaattatctgggcatggtggcgcatggctgtgatcccagctttgggtggctgaagtaggcggatgacttgagcccaggaggttgaggctgcagtgagccatgattgagccactgcatcccagtgtggatgacagagtaagaccctgtctcttaaaaaaatttcatatagttctatgaaaaattattaatttatggtggaggataaaggactcagatgaacagggatatcagactctcttctcaacccgtgtagcccttcacaacaccataccattccgtcataaagcaccagctgcctggaggtcacaccagagtggagcaggaacatcccaggctccggccaggctcagctcagcacaaccaagacttcagattataaactataattcttccccttctaacattgttgtgttttgtttcttttccaataggttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagacatttctaaaatcgcacccagaactgtctacaccaagagcaaagattcgactgtcaatcacactttgacttgcaccaaaataccacctatgaactatgtgtcaaaggtttgaagagccccaaattttcttaactctgtataaaaattaagttgtaatgagctgttacgagtaacctgtatccacaatagaagcccaaagcagccccctctgcatttgtgtgccgtccctggatggattcgagagtcaaccaggcctgcctctgagccattccctgtgtatttcctcagcacctccctgcttggctgcttccccttcaggcagaacacagtactgcctcagaccccaggcacagggggcctacctggcgtgtttcactcatacagagggcatcgggtcccaccctgtcactcatttcatcgtctaaaatgtaatcatgagtgtttgcttcgagccagggacagtgctgctgcaggggacccagctgggaccaaggcagactgtctctcccctcctgggatttacagggtcatggctctgaaacattctgtagtgttgtttggacacgagttttccctggagatcgctttctgcaggcctcttggtcctgactgtggcttcttttcagagcctgccattcgctgcaaggttgaacacccccatgggccctggacgaactgtcgtcgttaaaggagaagtgaatgcaaatgccaaaaggtcagtatccttcggtaccagtcacagtgcagatacttccgtgcctgttaccgccttctacccgtgaacggtcctgtgagctggaagtagggctagtgtcagaatcttcatttccaaagtgagatgattcaagcaggaggtggttagattgtgaacagccagtgggcagcagagccgactaaggccgtgttctgacctcggctttttctggccagacaagagagtagcatttttgtccacgaggcctatccttgccttgtagaactccagagcagccccgtaagatcaggcaacatctttctcttttttttttttgagatggagcctcactgtgtcacccaggctggagtgcagtgtcacaatcccagcacaccacaacctccgcttcctgggtgttcaagccattctcctacctcagcctctggagtagctgggattacaggcgcaccaccacgcccagctactttttgaatttttgtatttttagtagagacaggggttcaccatgttggccaggctggtctggaactcctgacctcaagtgatccgcccacttcgccctcccagtgctgggattacaggtgtgagtcgccacgcccagcccaggcaacattttttagggcccctcttgtcatgtgatttagaaaatttctgctttaacaactttttccacagacgtccagccttctgaaagcttgaaattagagctatttcctagaaagtggcatactttcaagaaggaaggaacacgggtagatgatgaaaagagaatacctgcttgagaggatcccaggctcctgcagcctgaagtagtcattcagtttagcgttaaaccttccatttctgtccaaccacatctcagcctcaatgctgattttaaaggggttttttttttcgtatttttattttgcaagtaacgaattagtggaatgctgactgggtttaaaatttcaacttcacctgcattcccatgtccatgtggatacgtgtgtttcatagagttagaatcatagttcaagtctggtcactaacattgctgaaattgccactactctgtcctacttggttaattaaggtttttttttctttctttctcaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgaggtgaggttccagtttttgaaaatgggacagcaataagaatcctgggagcaggggtgggataagtggtccatttaaatcaagtcctaactcagtatgtggaggttgtgtatgttttttgtttacttggagattgtaatttgccccttcctttttataacgtgggcaatcagtataaatggcaaagccagtagagtgtcaaattatgcacattggaattgacatttgtcatcatattaaaattcctgtgtagcccatattgataggatttaccaggaagcttgtctcaggactggagtcacacatttaatcatataagcagacttgaggactggagaccctaaaactgcttgcttgcactggccatcatctcccatcagggtaggtggcagtcctttctcctaaggagttagtcttgtttatatgtattcaaggaaaaatacatcagtcccttggaactaaaaggcatgcagtcctgagtccccagataggtgaatattgtaacacatacctttcccgaaatatgtttctgggatgctgagcagagaatagtctccttgtgatgtggatgccgggtgtttggccagcctcaatcaccagctcaggtgccactgcctcacacagtcacttagggtcattggtttaggttatcattctacagcattttaaactgacacattgtctggaccatgtgggttcttgaggactcatcaaaacccgttactaaaagcatgaatatcaggcgaaatagatagcaatgtgacattcgtatttatccctaagttccagtctaatgcagtgccctggtatgtggagtgtagacagatgtgggctaatcatggaaggttccctgggaagttgtggatattggtttcggaattcagaaagctgggaaggatgtggaaggctgaaggttggcttttctagatttagggcatgatttgaacaagtccttagaggtgggaagggcagcacagggttgttggcttggcaagagtcaaggtgcaaagggtgacttggggttcactggagggaaacagagatgagtgctctagaaggaagttgagccttgtggtgggtgacaggaaaccaatgatgtaacttgtttttgacctatctgggccccaagtttggatctgctatattaatataaaaaaggataataatgatacattcaaataatgctgaaaaatactaagatgaaaatacctccaacttcgtaattcaaaccataccattaggattaggtgaaccacattccaggcgtttttttgcagagacagtgaaagggatggctggctgaaggaatgaatagatgaatgttatatgcttttgaacaatcgtcttttccatttaattttctaattcaggagcagtaattatccttgtgttgatcactgctgacgattttctatactgataggtcctttccggggggcttccatctcttgccttttaaatatgcttgcattgagattatctcaggtctttccattatgccattactttcattttaaatcttcttgctctttcaaatacactttagttgtatctacagtgttttaaaaacaatctcattcagtgttgtaatttcatctgtgggctcttcctctggatgaaatccgtgttcctcccagctgttcggcagcatcagatggttgtgagggattctgttgttctgttttcttctaggcaaaggatgtgccttcttttcatttgcagtagtctgctcacccggaagcatgtcatttctttgccacttgcttgtaattcactggctttgcacttgctctgatacagtacaggtaactaattgactccctctgctgccaacttggttttccttctgagctatagcatcaggctgtgtgttttgtgttttcttgagattttgttaagtatatctggggtcccttctacctggttggaactgggattcccaccattcttgtggggatagaatctcaggtacacctatttccccaatcctctgtagccacagaagcttcatcttggccagctctgttatcagagtgcaggacttgggctgaaatttcctccccttcctgattttccttgacagtcctttccactgctcctatcaatcaaaagaatgaaaaccctcaacttgctgctttgcagattcaggttttgtgcttctttctggcctctcggggtggggccgggttagcagcaaggctgagctgcccctctttcttctgaagccttcatgggggcgaggagcacagggagagctcagtgcagggcctcccagtggccttctcagagtgggtggaaacccagcctggcactggcagcgtggcaccagaagtatgaagtgtaggtgtaaaggtgatgtaaaaggctagtaggttttttggtttttcgttgtttgagttttgggcatagatgactgtgaagggcgaacactgccgatggatctgaatgaatttgtagtatgtgcaccacttccgacttacgggatacccagctttgacggctttggacaaacacactgaggccaagatgtgctgagcttatcaggatcaggatcaccaagcagctgtaaaaaccctagcaagtgccttaagctgctgaaatttcatattaattgtctggtttgttcatggtcctagagtttgaggcagaaaagtcaggatccaagtcccttggttccaggctacagctggaaacagcatctcggtgaactaaagcaaccatattaggagttttcctgctttaggagagtccccagcatcggcgaggagggggcagcactctggctttccaggagcaaggggcaggatgcggccgagggagaggggctgtgttgaggaaaggagggccgcaggccctggggatggtgtgaggctccaaacatgtccgagtcacttccctgggtgggatgaggcagacagtgccaccaccagggacactttagttagattagggtcttggaagtcacagaaggaagtcagcagcagcaggctggaacttttctatgtataatcaaatggtttactctgacaccgttagcatgtaacaaacacaaaattttaaactaaggggaaccactaatggcatgtttcctttcctttcagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagatcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgctctaattgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatttgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaagggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttattttttaaaagtactcagtgtagaaattgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcaagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagtagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccaaaaaaaaaaaaaaaaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtctgcctgcctcggttctcattagtttaattcttaatgccttgcactttccagcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacacccactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaagtgtgtcaccagattttacttcattggcgctcgccagcccgccaggctggcaataaagtgcctccagccacctctggcaggtctcctcacccacagcccctgactggtcaccactatagttgtatgaggggccaggacaatcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtggggggtcatcataatagtctcattgttagcatatcctaataaagaatttgaactaataaatcctattaataaaattctgctttggtctgttatagccagtaaagttctaatacaatcattagtttgagaaatggtgactcattgctaaaacagtttgaaatttgta

SEQ ID NO: 53 - DNA, 3531 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaaacctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatagatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaaaaaaaaaaaaaaaaa

SEQ ID NO: 54 - DNA, 2077 bp, Homo sapiens
ccgagcgccagcgcggggaaccgggaaaaggaaaccgtgttgtgtacgtaagattcaggaaacgaaaccaggagccgcgggtgttggcgcaaaggttactcccagacccttttccggctgacttctgagaaggttgcgcacagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 55 - DNA, 9020 bp, Homo sapiens
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagtccagggccggctgcagcggcagctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagaatgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttcccagcacagaacaagactctggaaggagtaacggaccctctgcagctcttgtcaccacgtcaacaccctctgctttgccacagggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcaacctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacatagtgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaattccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttatccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttgggcatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatctttctcctttgaaatgtacagacaataaccaagaaaggaagtctccaggggttaaaaatcaaggtgacaaagtgaacatccaagagcaaagtcaacggccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatatccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcatctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacaggactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttatgtattcatattagtctttgaaaatgggtctgtcctccttgtgtaagacagtaactttacacttcagacagattttctgtgttatgaaatgtttcagtaaaatattgtttactgacctttaaaaa

SEQ ID NO: 56 - DNA, 4335 bp, Homo sapiens
gaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagtagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccaaaaaaaaaaaaaaaaaaa

SEQ ID NO: 57 - DNA, 2260 bp, Homo sapiens
aaaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaaataagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgggttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaaacttaaaaaaaatggagttgtttctccccacaaccgtgactgttacaggcagttcctcaagagactggctggcaagcaccataatgcacgttctcctgtagtctcacgtggacttcagggtccgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggc

SEQ ID NO: 58 - DNA, 11157 bp, Homo sapiens
gggggccgctacggtgctgacaagatggcggctggcggagctgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccagtggcttaaagaatgattataacaaagaaacattcaccttgaagcataaaattgatgaacagatgttcccttgtcgattcattaaaatagttccactcttgtcctggggacccagctttaactttagcatctggtatgttgaacttagtggcattgatgatcctgatatagtacaaccttgtctcaactggtatagcaagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgaaaaagagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcaaaaaatcgttgcttatatgtatttggtggccagcgatcaaagacctatttgaatgatttctttagttatgatgtggactctgatcatgtagacataatatcagatggcaccaagaaagactctgggatggttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtcttgtgtctataagaatgatcaagctgcaaaggataatccaactaaaagtcttcaggaagaagaaccatgtccaaggtttgcccatcagcttgtatacgatgagctacacaaggttcattacttatttggtgggaatccaggaaaatcttgctctccaaagatgagattagatgacttctggtcactgaagttgtgtagaccttcaaaagattatttactgaggcattgcaagtacctcataagaaaacacaggtttgaagaaaaggcccaagtggatccccttagtgctctgaaatatttacaaaatgatctttatataactgtggatcattcagacccagaagagacaaaagagtttcagctcctggcatcagctctattcaaatctggttcagattttacagctctgggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagatttttatttcttttttttttaattgggggaaataagcactattaacagattcagcactacaagtattttgaatgttgttgctgttggtcatttggcctgccttttcccttcctatttcactttgcctcccatcacacaactgcgtgtaaatggtgtcacttgttcacctctttacttcattcttaacaagtgtatagttctctaggacagttgatgtatgttaaggtgatatctgtgtctgtattgacttgtcttgtgttacattaaacagtaggcagaactgaggtctcaagtttgcactcttggccatagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtctttggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaatttctgaaatagttgaatattagaagtggcttcagttgccatgaaatgattgcttttctttttctttttttttccttaaataaaaataatgcagccttatatatgtctcttcccctcaagaatgtgaatttaggctgggcatagtgactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaacaaaactgatttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttcttccaaataactgtttgagatcttaaaacagaaaatccagtgttaatgggctctagatcttaaactaggtgagcagcttcttacatacaaccagttccttgttaaggatccagcaggaaaaccagccataaaacatttcaacatgcagtttgggggctcccttgcttattcactgagtttaagctcttgctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacagtttagctcatgtcatttggttggttttattttctagccctttaacataggaggaaaattgtcatttcatgtataacttgtaacacagaattgaactgatactagtttccttgccttaaattaattatatgtcatcccaagggtctctgttaattctgctttgccaagcaataatgagatctgggtttggcattagaagtatttcataattttggttttttatttaggtttcctccacatctgtaaagtgattgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagtgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaactgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgctaaaaaaaaaaaaaaaaaaaaaa

SEQ ID NO: 59 - DNA, 2516 bp, Homo sapiens
gaggtagaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagca

SEQ ID NO: 60 - DNA, 2564 bp, Homo sapiens
ataacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcggccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61 - DNA, 4348 bp, Homo sapiens
gggctcggggtccgcccgcgggctgccggtgcgagcgggcggcccggctcccctcctcccccgcccgccgccgccgctgtgattgggtggaagatggcgctggccggatggaaatcctaatgacagtctccaaattcgcctccatctgtaccatgggcgccaatgcttcggcattagagaaagagattggtccagaacagtttccggtcaatgagcactattttggattagtcaattttgggaatacctgctactgcaattcagttcttcaagcactttatttttgtcgtccatttcgggaaaaagttcttgcgtataagagtcaacctaggaaaaaggagagccttcttacatgcttagcagatctcttccatagcatagccactcagaagaaaaaggttggagtaataccccctaagaagttcatcacaagattacggaaagaaaatgagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaaggcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaagggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacggatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtga

SEQ ID NO: 62 - DNA, 1217 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggaaaaaaaaaaaaaaaaaaaaaaaaaaaaaaaaaaaaaaaaa

SEQ ID NO: 63 - DNA, 8105 bp, Homo sapiens
gtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctcttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtgtatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaaaaacagagacattcagtaagacccagaatcaggagaacactttcccctgtaaaaaatgtggcaggtaaggtgggcagcgctgtccccgctgggacccccgcgggctggtgcgcggagggggcgggggtggggtggaggggagggggaagaggtacaggcggtgtccgcctcgtttctggttggctcagcgggtttctagggttgtgacgtcatggggcagctttcggaaaatgacgcgagctggccggccgcggctgtgcagcgtgggggtgaaggtgaaggctggggctcctcgcgcacccgcgctgggggcccccgggtgggctaggccggttctgagcaacccccacccggctgcagggtgttttacaaggtgaagagccgcagtgcgcatatgaagagccacgcagagcaggagaagaaggctgcagcgctgaggctgaaggagaaagaggccgctgctgccgccgccgccgcccaccagcaggccctgcgggaggagagcggtgcgggcgacaagggctgagcgcgggagccaggctggcccagtcctgggcctcggcccttcccgcaccgccgccagcgcccgcagacaccctggcatctcaagagggagtgaggagaggattgcagggacttttccctgcgaaacaaatgagacaatgacataaacggctcttttatttatgaaggccctgggagcagcgttaagggctccaggatccagctctctttgcatttggtctgtcggaagctgtcctcgtgctttcctggaccgggagagtcccggtcccctcgggagggactccaccgcctctcacactccgatttctgctgctctgctgccccgcagtcttttccctttatttgcttccccctcctcccctcggcctccaggaagccaccgtggccggccaagcacaagctcacccactttggagcagcatttctcctccccagaggacctcgaaggctgcaacggccctgccccaagccccagaaaaagaaactcttggagggagtctgcgggcttctctgagaaggggcgcagcctgacacctgtgctgtccctgcagtctctaggcctgtctgagctgctcccgtgaccgtgtcctgagtggccacctcctccttgggagggaggccgcggcaggtactctccctttgctgcttgctggcggccttgctagggctagaaagttttctcagcgttgggggaggggctagcgttcttgtccaaagcactcatcctgctgcagggaagggagctgtacggaggctggaagctgcagggttaggcccgagagagcttttgacaagcctggctcttcctgcttcccacctttttggctgaatacctttgggtcctggaggctgccaagggcgcttcgccttgagcaggtcccggagaggctcagcctgcccctcctggggccagcctccttgcctctgctctgacctcagcagctacacctaaccccaccgcaccctacccagtgtcgatatccacaacccagcccccaggcctgcacgttggagatttctggatccttccctgggagggagaggtctcctaactcgattggacaggagccttcattccttgactcgtgtcatttgggagctatttatttattcttagtatttaatttttaacatcctctcagggaccaggggcctcctgcttttcagaggcccgagtgcatttatcccaaaacgaggcatcttgacatcccctatccccaccccctaaattcccaaggccctaaggtccctcacctggttgctctggaagctcttgctgataggaatgatagcaacactgaaagagcgtgggaaggtggagggtgtcaccagacccacacagagcaagggagatcaaggcagttcttgctgccccttctctggctgtgctttgcctgagggaagagttggcaagaggccagaattctagtttggtttatggggcctggattctggcttgaagaagccatatttggcatgggtgaagtgaaagggccaggaggttctggaggccccttcacttccagtcccatagcggggctcagctatttttctgatcttattcaactttagttgtgcaaaagaaattctaagtgaatgcgcgtatgacaggtcaacgtattaggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttatgtttcccaaggtcttttctattcaaatcatatttggtttcaggcccctttatgggcatacggtaacagaaacctccatcattcatatgagacccttttgtcagtggtaacatcttgtacttggaaaaaaaatttttttttttttttttttttttttttgagacagagtctcattctgtcgcccaggctggagtgcagtggtgtgatcttggctcactgcaacctccgcctcttgggttaaaagaattctcctgcctcagcctcctgagtagctgggattataggcacacaccaccacacccagctaatctttttgtatttttttttttagtagagacagggtttcgccatgtcggccaggctggtcttgaactcctgacctcaggtggtccacccgcctcggcctcccaaagtgctggcattacaggcgtgaaccaccgtgcctggccggaagtctttaaaaaataaagtgattctactcttctaagcttacagagaccagaccaggtgaatgtaactggggaaaatcaagatggtacctctctgcattatcccgccagacactgtattttatgcattcatgtctaggatacagtgtgaaaattaaaaagtttagagggcagatgcaattgtggcaagtgacctgccaataaagcaggtgcagctatagaagctggcataggtatatccttaatggtgctttctccctgggcttgtctttttgttgtttttttccccctatattcagagctccttgagaagtgataaacacctccagctttctaacatcctccccacaccatctcaccatatccatctcccagcatccatctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacaacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggttttaaaaattcaaaaaaaaaaaaaaaa

SEQ ID NO: 64 - DNA, 500 bp, Homo sapiens
  misc_feattre (452)..(452): n is a, c, g, or t
  misc_feattre (479)..(479): n is a, c, g, or t
  misc_feattre (498)..(498): n is a, c, g, or t
agtgctcacaagtttatatttttaggtttgaataaagattcttgtgtattttctaaatacacagacaaaacagttccggaagtttacatacatgtcttaggacacttatattaggtaggtaatttacattttaaaaagttggtcttcgtaaaagatcttcccaaagagcttttacaaacagcaggcggaagtgttcttttgtttacagtgttcaaaatgccaatgctcccactaaataatggcctcaaccatctctcctcaacccaaaatattgttctcaatagctagtgtactccaaatttaagtacccaatgtcataaaatttagggctagaaaacatcttttgaagtgtgcttatccctaacacattttaaactatctagaattctttaacttcagttgaaagcagagatacagcagaaaaaaaaaaaaaactttccattttaagtccnaaagtggactaaacacctgttagttcnaagtgtggatattatggtncc

SEQ ID NO: 65 - DNA, 5402 bp, Homo sapiens
agtgacgcgggcgctgcagccgtcgctaccgccgcgttctattctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctgggttttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggccgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccatgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatggactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggcaaaaaaaaaaaaaaa

SEQ ID NO: 66 - DNA, 2088 bp, Homo sapiens
ggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaaaaaaaaaaaaaaaaaaaaaaaaaaaaaaaaaaaaaaaa

SEQ ID NO: 67 - DNA, 1074 bp, Homo sapiens
ctcggggagtggttgtctccctttcctggagtcatttgtgggagttagggtcttatcctgatctttcctcgtcccccgctcccccgtcctccgaggtggcagctgcgtagaagtctggaacgttttttcttagagttccagaattgtgactgaagtgtacccagagacacaaagaaatacagaagtccagaatgatcaaatgagatcactacccaatgaaatgataggccgaggagccagaaattgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtcctgcccgaaggagctcagagctcaagcacagagatgtcatcctggaatcagaatcactggctaagtcttgctgcttgcttcttgctcagcctgcatatgagaagtcaaccaagcattctcttggatgcaagatccaactgcacccatgggaaatctgaacttccactttctttgagcttgtctttggttgtaataagaatccatcaaaacccatgtctggatctctctttggctgaggcagctttatttcctacagagtttctctgtcctcttgttaggacaatcagcctgctgctttgggcttttccaagagcctatttttcatctgctggatgcctctttttttttttttttttgcactttgtgacatgctttaatatatatattttttatgtatccaaagaggtaatcaactttaactttcagaattcatgaatcttggtttggtggcatgaatgaaaggttatgtaaccccaccagtaactcatttggggtgcccttgaaatattaaagtttggtcctcaatcaaaaaaaaaaaaaaaaaaaaaaaaaaaaaaa

SEQ ID NO: 68 - DNA, 5096 bp, Homo sapiens
atgaggagatctgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcccagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttacatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatatt

SEQ ID NO: 69 - DNA, 1845 bp, Homo sapiens
gtctctgtggttataaagttgggggtggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccattgcaggaacaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcttctagcaatcctgaccttcatctgaacagggcgacgttgcataaatatgaagagagttatggggaggccctggagggcttctctcgggctgcagccctggaccctgcctggccagagccccggcaacgagagcaacaacttctggaattcctggatagattaaccagcctccttgagagtaagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttacttttagcaatttttatttttatttttgaactttaggtccttcctcttctttggggctggaacagaattaaatttgtttg

SEQ ID NO: 70 - DNA, 2705 bp, Homo sapiens
cgtggactgaaagttgcacggcggcgtgtgcgtttcctagttgtctggtgctgctatataggggacgtggggtccccacagacctgcaggttccggcccctcttttctcaacccagagcaaattgaaacgtccgggtaacacaccgctgtgccacggttttggcgagggctgacaattgtgagctgtagaagtaccagcctaacaactgttcaagtgactcctgacctagatgggtggtttcatgcacctccagtacaactgtggctcctagcagctgtggcacaggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagtttcagtggcaagaagttgaaagaaatggccatgaagcacccatgacaaaaatcaaaaagttgactggtagtacagaccgaagtgatcacaggcatgctggaaacaagcctattaaagatcagcttggattaagctttcattcgcatctgcctgaactccacatgtttcagactaaagggaaaattagtaaccaattggacaagtctatcggtgcttcctcagcttcagaatcccaaagaatttcttgtaggctcaaaactcatatttctaataagtatgggaagaatttcctccattcttcattcacacaaatacaggaaatatgcatgagagaaaaaccttgccaaagtaatgagtgtggcaaagcctttaattatagctcactcttaaggagacaccacataacccattcaagagagagagaatataaatgtgatgtatgtggcaagatctttaatcagaagcaatacattgtatatcatcatagatgtcacactggtgagaaaacttacaagtgtaatgagtgtgggaagaccttcactcagatgtcatcccttgtatgccatcgtagacttcatactggagagaaaccttacaagtgtaatgagtgtggcaagaccttcagtgagaagtcatcccttagatgccatcgtagacttcatactggagagaaaccttacaagtgtaatgagtgtggcaagacttttggtcgaaattcagcccttgtaattcataaggcaattcatactggagagaaaccttacaagtgtaatgagtgtggcaagaccttcagtcagaaatcatcccttcaatgccatcatatacttcacactggagagaaaccttacaaatgtgaagaatgtgacaatgtttacattcgcagatcacaccttgaaagacataggaagattcatactggagagggatcatacaaatgtaaggtttgtgacaaggttttccggagtgattcataccttgcagaacatcagagagttcatactggagagaaaccatacaagtgtaataaatgtggcaggagtttcagtcggaagtcatcccttcaataccatcatacacttcacactggagagaaaccttacacatgtaatgaatgtggcaaggtttttagtcgaagagaaaaccttgcacgtcatcatagacttcatgctggagagaaaccttacaaatgtgaagaatgtgacaaagttttcagtcgcagatcacaccttgaaagacataggagaattcatactggggaaaaaccatacaaatgtaaggtttgtgacaaggctttccggagtgattcatgccttgcaaaccatacgagagttcatactggagagaaaccttacaagtgtaataaatgtgcgaaggtttttaatcaaaaaggaatccttgcacaacatcagagagttcatactggagagaaaccttacaagtgtaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacgtcattcataacttgtagttcatcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttacttcatgttcacacctcattagacatcagagaattcatactggacagatgccttacaaatgtaagggtggcaaggtcttcactctgtggtcattccatgcagaacatcagaaaattcatttttgagataattgttccaaataaaatgaatataaaaaatcataaaactttaaaaaaaaaa

SEQ ID NO: 71 - DNA, 417 bp, Homo sapiens
  misc_feattre (43)..(44): n is a, c, g, or t
  misc_feattre (48)..(48): n is a, c, g, or t
  misc_feattre (397)..(397): n is a, c, g, or t
ttttttttaagtagacatgacagaattttaaatttataaatcnncccnatgtatcgcatacattcactttacatattcaaaaaacgctaaacttaagaaactgaaaagttgaaaaataagaggtagtagtacccactgagtgacgttctggcattctattaaatattctacattagaagattatagggaaaagggagctgaattctaagagaacaaatgtagagaaggcaaccctatggtcttgggaaaagacaataatggaaggaaaaatatattcaaaatgtattgtacaaattgttagacatgcatcacttacaataaacagaagggtaattattttgtggggtaggcataaaggggaggaagggggattggggcccgggcacctttggcctcnacggtcttggtaattcttcc

SEQ ID NO: 72 - DNA, 1534 bp, Homo sapiens
cctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaattta

SEQ ID NO: 73 - DNA, 299 bp, Homo sapiens
  misc_feattre (190)..(190): n is a, c, g, or t
  misc_feattre (199)..(199): n is a, c, g, or t
  misc_feattre (205)..(205): n is a, c, g, or t
  misc_feattre (224)..(224): n is a, c, g, or t
  misc_feattre (238)..(239): n is a, c, g, or t
  misc_feattre (243)..(243): n is a, c, g, or t
  misc_feattre (262)..(262): n is a, c, g, or t
  misc_feattre (287)..(287): n is a, c, g, or t
  misc_feattre (296)..(296): n is a, c, g, or t
tgattggcttaaatgccaatgtagtttgtttctttgtctttgtacctggttctcttttctgtttcttttctaatctttgttttaggccttctagttccacaccatcttcttgagggcttccttcagtattttcattcttaattttctttttatttttcttttctgcctctgctttcatttctatggttantcgtggaangactcnttgaccacgcggagaaggnaaaacttcaggcannttgnggtgtttttcccccttggnccttcccccctttccccagggaagncgaacttgntca

SEQ ID NO: 74 - DNA, 4073 bp, Homo sapiens
cggcggacgacccaccttgagatgcatctagcgactgctcccagcatgtaggagcagttgtaaaatcacagccgtaacagtgcctgctctccagtgtctgaaaacaaatgtttttctggtcttcacttttttgaggcaggaaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctgttttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaatttaaaaaaaaaaaaaaaaaaaaaaaaaaaaaaaaaaaaaaaaagaaaaaaaaaaaaaaaa

SEQ ID NO: 75 - DNA, 2465 bp, Homo sapiens
gagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttggaattcgatatcaa

SEQ ID NO: 76 - DNA, 2647 bp, Homo sapiens
cgggtgttgtaagatctggggagaggggaagtactggctccttctaatcagcaacactgtgtgggcatacaatggaggaatccagtaatggaaactataggcctgagtaatttagaacagaatttcacaattatatacagcatataggtagggaaggacatggagtatataattgtaaatattgtgtgggctccgcgcgctgcgggctgcggcagggtccggccggatgtctctgcagagcctggagtttgcatgaaactttcacctgcgctccggggagactttcggttccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaaggatctgtggaccaaaatcattcttggctcgggagaaaaaggaggaatccgaactgaagatatcttccagtcctccagaggacactctcatcaaggcccgagcttttggttacaacttagagaccaacagcctgaactcagatgtcagcagcgaatcctctgacagctccgaggaactttctcccacggccaagtttacctccgaccccattggcgaagttttgggtcagctcgggaaaattgagctcctctgtcacctccacgcctccatcttctccggaactgagcagggaaccttctcaactgtggggttgcgtgcccggggagctgccttcggccagggaaggtgcgcagcggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtcagtgcccacgcgggccccggagggcggtcgctggtgggcgccactgcattgcaccagccctggagggagccgggcctggctgcacaggatgtggtcagggcagactagaaatcctcacttcctcagatgttttccaccaaagctataggtctttttggagttcagatgagaatcctaaagactggacttttgattggataaatgtgctaacaattttcagtataaacaaacaagagactagatccttttctccacggacacccaaacctccaccccccaccccttagtagtgctggggatccgaggccactgcccttcaccagtgcactcgcacgaggctacctcgagcgggcctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgccatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactggacaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccctcctcacatggcagaagaaatggaaaggaaagaaccttctcactctccccagcctttttataagggctctaatcccacctgtgagggctctgtcctcatcacttaatcacctcctaaaggccccacttcttactactatcacattgaccattaagtttcaacatacaacttttcatggacacattcagaccatacgtagcacctgctgaagaacatcttggttccttccaagttttggcaagtatgaataaagctgctataaacatgaaaaaaaaaaaaaaaaaaaaaaaaaaaaaaa

SEQ ID NO: 77 - DNA, 2979 bp, Homo sapiens
agcaaaccaatcgcaagcctcgttgagtggaaggggtgggatcttccccggaagttttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagagcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattccttcgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaaccatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttg

SEQ ID NO: 78 - DNA, 5171 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggaaaaaaaaaaaaaaaaaaaaaaaaaaaaaaaaaaaaaaaaaaaaaaaaaaaaaaaaaaaaaaaaaaaaaaaaaaaaaa

SEQ ID NO: 79 - DNA, 7759 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttttggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaacattttttataaatgatcttggtctattggggagcggggatagttaatattccagtacactgaatacatgaggaatttaaccacatacatcattgaagacaagggatagcagtttgtttttattcaaagacattgctgtgttctctttcattgcctctctcgctttctgtcacttttttcctccttacattaaagaaaagtttaattacagttaaaaatgtataatgtatttataatattcatcgataccattattcaaatattgctcaatacagcaaattagctcctaacctaacaaagtttaagtttacttggattgataattaggtttactctttatctgaataagaaccaattccatttgtttgaaatatggagtttgtgactacccaaattgctaattattctttcttttgaatatattttacatttctatgagcctaaggaagattcatgaaactgacctatgagagtcgtgaagtggtttttcagaatgctatgtaaggaccgatttgagcactaactataggtactctgaatatatatttcccttgattattcaccaaaagtgttccccagtctttgactctttaaattccaatactgattccaaaacaaataaatattttgaagactcaatgaatactttccatattttggcctatttatataagaaagttaataacattgacccttcacagctcttctgcctgctcctcaaagtggctctatctaaatatttattactaaaatgtttttcctacagtctacatgaatacaaacctcaatagctaagcttgacgtatttgtgcacaagtagatcactacattaagttttgggaattgcacttcttaaaaatgtctccccaccaaacatagtaatcctgtagttatgcctacacaaagcttgccatattctttggtgcattcattttgtaaacccattaactttttattgtgaagattttcatttgcagtttcttgcactgcttttctagttttttaaaagcttgagatttatttatacttcttgtagtaactgcatatttctgtgtgtgtttagtggtaaagaattaattttgataggtacaatatgtctatcagattgatatatacaccagcctatgtcaattggggctaattattttaaatgaccatgtcaaattgaatttggagacaaaatctgttgagagtgcttatgtaattaatgatggttctactaatctaaattttggaaaaggtgataaatagactatactaaaatctctctatgccatagaattggattatcctgtaggtcatctcattgggtataagacaaaactacctactttttttcaaaagtgcactgaaatcacataataaagaggctttacctcttggttggtcctgtgaccctaagttctagtcagatagacacagaggcaatgtgaatttgagtggcatgagcatgattaggttattccttccagcatctagtatagcacctggaatatagaaactgtctaatacatatttattcagtgaatcaatgagcagaagtttgccaggacagtacacattggcaaggcacataccatatgattgaagtgcttcatgccattacagtccatcaggctgataaagtgaattatttctgattatttaattacagaaatatgaatttatcttcaagggtgtagtgtcatactgctgtacaacacagtgctttatttatactaataatttaggagactgatacttccaaatgatagtggacattactatcacaagaatatcacttttcatcaaactgcaaaaatacagaaaggcaaaaaacctgacacttattcttaactgcaaattaaattcctgcccaggggatatattttaggaggggatgaatggcagcttttgtgttttttttaacaagcttgaaagggaggtggaaaacaaagaaattatgtaaatggcatatgagttttattatctaggcattcgttagtatggggaaacctgataagaaatgaaaatcccaaatgatttcagccttttcatgatggttgaggttagatttcagagatgtacagagactagagcggtggttagaaagaggatatatgtagtcacagcagaaagacgtgtctaagtttaattttattggctttcaagttcactcatgtatacttagtttgtccatacatatgtctaatcaggaaaaatgcatgtatagattatgacaattcctgaattttgaagtattggttaaaagacaattaaaggccaagaaaaccatggtggaagaagtaagcgaatgaaatgtagaaatatatgtaaaattagcaagtgtcaattttaccaagtagtgttgattttccaaacaatgaatttatatactatgctgagtcacagagaagaatgatcacatgttacttaatgagagcagtttacttttcaaataaaataggtatgatgaatgtcttaaaaatatcttgaagttgaagaaacaaaaatgagttatctcaatatttaccaagttaacctagtgctgtatatatcccaagatattttaggtaaatgtaagtgtttaatcatgccagatttaaactagtctgaaatatagggtatacatatatttctacttacatttctttattttatgaaatatccgaccatgttgcagaaaataatgcaaaacctcatgtaagttaactatgaaagatcctgtgagcacattggcattgagtgacagacaaactaaaaactggcaaacagtattttaataagggggtcactctgtggcagtattctaatattggattttcaagtagattaggctttttatttattcaacgctttttataattttgttctttttgactccaaattattggtcagctttcaaccttctccacatcagcaatcactaatagttcttttggttgagatcaactcagaaaaagaaaatagaaaacttttgttctttgaaattttagacatgcataatatctatttattttcataatttaaccccaaaagcttctcctgcaatacacaggattctaggagctgaatgacacagggagactacagagtatttattattacaaacacataaaaagcctaacttgaagaattaaaatttctattttttatctgtataacaagtacaaaccatcaacaatgacaaattttcacagctgcttgtttattgcttgttttatatgtttacatatctcaaaatctgttaaaactgaggtctaaaaaatgtgcagaattgtgcaactgtggcctagtccataagacttttctgagttgcaacaaagtgctgacaaagtgacagatgtctgtgatgtttcatgacataggttatgatcgagccaatttacaaaatttaataaccaacctaaactcacatacatatttgttaagaagctgacatcagttcagtattgtaaggaaactaactaggtggtgatgatgataaaagaattagggaaaatattttatttgatatattcccttttataattcctaaaatgaagattctatttaagggttataatttatataagtttagtcatataccattacattatgataccataagcagagtgcattatgattctctagaaatataattcaatcagatatgtattatatttatttatgtcacacattttctttactgagaataaaaattatcttattttcagaagctttgtatcaatcagtttcatgtaataagcaacccagatatctactagattatgtatttcttcatttgaaactacactgttttctcctagtccccttgactctactgtgcttatccattctttcacagaaagaaagtaacagacataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaatgtcgctgtgttttcttcctgatgtcaactcacgtcaggaatactttacctataactatgttaagtattttgctgaaatcccatttgatgtgctttgtcaaataatagcacaatgtaatgcaacagccccatgctatctggaaaaattagatcattttgttttatattccataatcatgtgcataacaaattattgttgatttaatataaatatgagagttgctcttttccgattttcaacatgatgtttctttgttttattatctcaagattattgttcttaacacagagtgcatttataaattattgtaagcttagttatttccctttcttgtggattttggtgtaatttacaggcagccaaaataagaattgtccttgctcatagtacaaccctttaattgacttgtgcctgagttttggtgtgagctgagtattggtggttatgaatactgggatccccagctatttgttcatgtacttattgaggtcactattggtcttccttcttcaatgaagggagaagctctgtcaaatgtagactgcaaagtcaagctcattaaaagtatccctctttcttcgtgagaaaagatatccaaggagaattctgtccctggttcctcccatgtgggggttctaggcctaggaccagatcttattgtctctacaatcttgattctttagtatttcaggataggcagagttttgttaaagtatacaaaaatcatagctagataagagagataacagaaataagttccagtgttctatactcctgtaggatgactacagttaatgctaatatacagttacaaatagctagaaggaggctattgaatgttcccaacacaaagaaatgataaatgtttgagatgatgatgtgctaattaccctcatctgaccagtatacattatatgtatcgaaacatcgctctgtgccctgcgaatatgtacaattgtgattattaaaataaatacataaataaaatttaaaagtcattatga

SEQ ID NO: 80 - DNA, 4331 bp, Homo sapiens
aagaattgatctacccacaatgtcaacaagtacccctttgaaaaacgctaccaactaaatgggctttggcaggccttcctgagaatctaaacacaatttttaatgtggttgctctggcagagactgctgtctcatcagcctatttttagactaccaaacaagtatgtttgaattataaatttaacctccacacccatttttctttttttaactttttattatggagacttttcttttttttttgagatggactcttactctgtcgcccaggctggagtgcagtggcaggatctcagctcactgcaacctccacctcccgggttcaaccaatcctccctgcctcagcctcctgagtagctgggattacaggtgcccaccatcacgcccggctgattttgtattttttagtagagatgaggtttcgccatttggccaggctggtcttgaactcctgacctcaggtgatccacccacctcgacctcccaaagtgttgggattgcaggcgtgagccaccatgcctggctgagactttcaaatttatataaaagggagaaattagccacccagcctcaacaggttttatcaattctgtttcattatctccatcaccaccaacacctcttcgtcttctaattgctggagtattttaatgtaaatctcatcctatcctttcaaccaaaatttctgcaatagtgactaatacatgcccttttttttgaaacatcattatacgtaacagttgacagcagctcttaagtgtcatctaatatcctatttcatgtacagatttatcagattgacccagaatgtctttttatagtttttttgctttgttttgttttacagtggtttgttcaaacatggattcagataaggtccacacattttagtctgtaatagtttcttctcaccctctctcacctttgttttccttctatgtcatttatttgttgaagaaactggatcatttttcctgttgtggaattccatattctgggtttggctgattatatgtttctctgtctctcttactttccatgaactggtggttagacataaagactttcagaactgattggtaagatatacatttatttccattggattggaagtcataatatctgattatcccctttttttttttttggtcatgttgagattgattatagtagttcagctgttgtaagtctattccacccataaagttcctcagcaaactttaacctaatggttttaatagtcattgatgatgtttaaatccatttcattaaatgctgcaaaatggtgatattctaattttttaaattctaacttctgcattcgttagctggagttttttctacaaagagggactttgccatatcagctatttgcttcaattgtaatatgtaatgaaaaggcaggattaggtgcttgtttactcatttgcagaataataacattccttgaaagtgaccagtggggttttagggtttttgttttgtttgctttcttttcattttgttttattatgagatcatggtttttgttgtggttgttgttattgttgttgttttgtattggttatattttagtccactcagtccactaatatcacttagtttttattacggaaaatttcaaacactctcaagtagacagagttgcaccatacagtgaaacctcttatgttcattctctaacgtcaacagtgatcttaacattcaaccaatcttatcttcatctatacctgtactccagccccactttcttctgcccttattttagtttgatgcatatccaatcagtgttcaaatttaaaatggtctaaaatattttaaaaatcagattgcttgaatcaaaattcagatctaccacttagtacagtttatattgtgatatgtccttgagtataatctatggacaccccctcaactcttgcaatttatttaagtaagttgaaacatttagtcactagagatttccacgtactagattttgctgatttcatttatttggtatagtttaatgtattttctgtaaattggtagagtcaaaaagaaatagagcgtgggcctagttggaaagacagatttcattcagtactattgcaataggggaaaatagaaccaagttccatttcagaatacaacaaagacacttggggatgaagcagagtgagagggtcaatggatggaaactttctaaaaggagacatcaaaggtagaaggtttctttctgacctgacttaggattcctgctaaaggcaggccaaggtgatcatagatccagagtgggagatagtttaggaggattcttactatatataactgagctaaacagactgatgacggggctcaaggacaaatactagttgattgctcagagcagcctgcttaaaagtatggtcaaggagagaatctttagtgtagaatggtgatcagatttaagtttgttgtcctttggttcttgttttctttctgaaaagcaagacctgcttcaaaggtggtggtgtgctctcttgcactaggaggtatattatgtcttgtattcaggctatttgcatttcagattacacagttttatgtaactgctttaactttgtgtttgtactgaatattagtttcttgatggcagagaacatatttcactttcagaatgtttttctgcttacatggatttattttcaagaaatttcatacaatactttatttagaagaaagcagaattttctgaaatcacagtatgcagaggcatttaccatcaactctgacaaacatccttctggtcccttttctatgcatgtattctgtggaattggatgcaaacacatattaaaaatatatacatttgcctaatggaaccacagcatacagagtattttatagtctgcttttccattcagtgatattccaggaaaatattttcttatcagtgtgtttagatacacatcctttcaataggtcatcatttaaatttctactgtctaacattattttaaaagtaagtttttctctaataatcagcaccacattaaacatactgtgtagctttcactttaaaattatttttatggacatttgatatcattagcttgacattattaataacagttaccttgactttttgatatcatctgtactgtcttggaaagtgaaaatatttgtcaaactgttaaatgataagaaagaataattatacactgccaagcagaatttccttcttttgctccctccccaccttctgctccaatcacataaataagagctgttttttctttgcagtatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagt

SEQ ID NO: 81 - DNA, 6126 bp, Homo sapiens
cagacaaggacagaaagggggctggaggagaaagagagagagagatacagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggccccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacaatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttagaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgaaaaaaaaaaaaaaaaaaaaaataaaaaaaaaaa

SEQ ID NO: 82 - DNA, 1222 bp, Homo sapiens
  misc_feattre (970)..(970): n is a, c, g, or t
cagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagacaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcacccgtgcagccccgccatggccgtgtagaccctaacccggagggaaaccctgactaccgaaaattacccccgggggcaccccttaaaaaccttcccactacccttttaaaaaaacacaagccctttatcccagccatttatttttaaaaaaaaaaaaaaaaaaaaaagggccgggcccgccttcctaagaaggtattcccccctcccgaagggggggcccccaaaagcttttaacggcggttaaccccaagcctttttcctttgtaacaaaaaaggggggctccccctaataagatggaaaactcgccaatttatataaggctttagggcccaccttggccccgctccggtnttttaccaaaacaggtaccccggacattgtgggaaaaaaaatttgccttaaactctggggggaaatctttttttgtgggaaagagaaaaacccctttacactcttccctggggggggggggggaacaccttaaaatttggggaacacaaaactttcaccttttttcgggaggagtttttttaaaagggccttctcaaagggggggttaaattattttcaaacccttctttttttacagaggggggaaataca

SEQ ID NO: 83 - DNA, 4409 bp, Homo sapiens
tttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcatttt

SEQ ID NO: 84 - DNA, 4966 bp, Homo sapiens
aattgtaaggactctgcattgctccatttctttttaaaaatttttcttcaagaaggattatatattgctcatttctgtctccaccccagaagtcagccttttctgaggtccagtccttgcacctctgttctctcccaccctcacttcctcgcccccttttccctagaaatccccttacttggacagctttgcctcttacctgcattttaatccttgcagcctcctaagcatcggttccctttgatgaacagcactcaccttaaactcaaaaagcaaaccagtcctcttcccactccaactgtcccttttctcccttcttgtctcccttatatcacctttctccaagtgattcaggtcttaaccttggaacccttttctccttcctctcttccatccagtgcctgggttctgtccatttcgccctaggctctgtcatcctctcttcccctggcccactctgctccatgctctcacggccttggcgtgaacttgggataagatgtaaattcccagactcacaattcctgatcttttctcagctgattgcccctcacaaagatgtgtttgtccgtttttcagcctgtttaatctctgtccgtctcatgagaccccctccaacctcatttcctttgagaagccttctctgacagctgaagccaatggcaaacactttgcctcttgaattgtgccagcatttatggtctacaccagaagtcgcaaacagccatatctcattaaaaattgttaaaagttggttgtcatcatgtgaaaaccagatggtttgatgtaacaattctgatttctggcttctcctgaaagttgagaacatctggcaacactggctttgctttcccacgtggcagtgttggtttggtgcagaggagtggttatcgcctgtcggcagatcgtgcactcccagcaggatttgtgcccctgtgctacctatccgactcctctggacaattgcatttgcaacccttgtctataccatcgatctgccatgacttagcaaatatgtcttgtcttgttattgactgttctgtgtttacatgtgtgtcttatattcccttcacaattcaattgccctcttcctgagggtagggagtctctgttaactttacatgcctcctgcagtacctgacacatagtaggtctgttgtttgagaggccagtgcctgaggtggaatttgccttatgacttgcttctaggtcagtggttctcacttgcaccctctgtcaacattataccaggcttgggggtggggtacactctgtccagtgtttactagaaagttccagcagaggtttgaagcatgcccaccccttagcattacagggttgggcttgtggtgaaggcaatggcgggtgtcatttgcagaacccccctgggtgattccagggcatcccctagtggaaggctcacgtggccattttcagcctgtgttgtaacttattgctttagataaaagggacaaagtatttcaggtaagatttgacctctgggaaggtccagacccccagatgcgttttctattggaaattccccagctggggccgggccagagacgaggagggctccccacaattctgagagtggctggtggcctgcacctcatttttgtcccccaccttcctttccctcacccctttcttcagtctttacctcttgctctttccatccatttttacctttccacaagctctcggttctatggatttgtgggattttatttttcttccttccccatgtgcaaatctacccctgctgtgacatgggagagagtgtaagaggacacaccagagtacatactgccttcttccaacccagctttctaacagcagagctgctgagggaccaatggccagtaaaggtgcagagaaggacatgaacccttcctgttgttggaaagatttaagtgtttctccctggagcagttttcacaactggtttgccctcctttgcttctgcgagctgctcagatagcactagatctctgcagcttgcacaggcaggccaaattcaaccagatacttcttattctaattcatatgtccgttctctaaattcttctttctattttactgcttcattgtatttgtgctaagctgcctcataacctgaagataatctaaaatatggctttcctgccatcagcatagccttcagctgctttagggctgcagatgctgcatttctttccactcagaatttttcggaactgtttggggatgcggtgttctgaagcactgcatgccgcggagatgtcgcatctgatggagagtaactgcaacgtggagagttcacgttggccatctccagtcttgtatgacagatgcttaacttgtgtttgaaattttcagagatcatttccatttttgcatagcaaagaatctatttcttgtcctctagctagaaggctttgcatggctagaataaatttcttttcaacgaaacggtatgctctggcaaatcttcctttggttcaaggcagcccactaaacccgctggcgtgtgttgatgaagtgtggtgcaggtgcagcgtgccactgcagcttctgggcagcctgagttggtgccatctaggtacgctcaggcttctgttccacaagtaaccgccccagcctggtccatagtttgctgctccagtagatggcaaataacaaaagcaaatagaacagatgtatcccctcttgcacagcctcacctaccagtcggctagaaaagcccattgggtagttggggagaaaatagcttggtaatgccgtgagtttgttgggtgtctaactgaacaatttgctgctctagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaagggacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggctgtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgcc

SEQ ID NO: 85 - DNA, 2643 bp, Homo sapiens
tgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcagatgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgccgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaaaaaaa

SEQ ID NO: 86 - DNA, 2428 bp, Homo sapiens
agctgacggctggatgacccctctgaacggtcccggctgtggatgcccatagagaaacggggatttcagctttggggctctgattcttcccagatgagaggacgcatcggggctgccgctcgctctacgaggccagcatgggggctctggatgggtcacttgttcttgcccaaggggtgaatgatgacacagactccatgccccaccccctcagctgcccagccagtctgaccaagacggagtggcccttccacttctattctccgcgggtctccgaggatgtgggatgcgggagagggaggaggggcaggaggaagaccaggaacggaggacgggagctctgtgcgagagacacgggttcagaaacccagcagcacagcagcaagcgccctcccgccccccgaccagtgactcccacggcaggtgcaatccacaaaaccacaggccacccaaggtgtacccgcctctcccaggagcctttctgccagagaccccaagccgggtgccctccacactgggccgcaagggtaggtggggccgctgtggcactggtacccagtgggtgcctgtcaaacaggtgtcaaccgactaattgcagcccagctggtcccagagaccagccagacacccttcctactgaggatgaggtcctacactgcgagggcccccactgtccggctgtcccggacacagccccactaagcatgcgggaggcaccccacttggcaccccgcagcccggcccataccagccagcagcctggccctggctggctgccctccagcaagccatgactgtcggcccggcttggaggacgtctggtcaccttgcatttgcagtctgaggaagctgtgtcattccgctacatccagaggtgactcaggcagctgcagcagcagagagcagactgcagaacacaccacaccccctccagtccccgccctggctcccaccacaccatcctcctgtcctcggcctccagctccccatcagcatcctgttctcccccggccgccctggggcttcaatccgctcccagcctctaagtccagtcaggggcattccggggggcccagatgccccccagcccccaaccgcatcattcaccggagttgcccctgcccctctctcttttcctcatccacgcgccaaccaggcttgatcccagccctcaagcatcacccgcctgaacccacagcacctgcccaggctccggcctccagcgtctcctgtctggaccacagctttgccaaatgggatgccctcaccctgatcctggtgccccccacacagccccacaggcagtcaaaagtcttgggggttcctcccaaaccccgactcccccaccccaatgccgtttcaggtttctgatcaccatctgcagagagcacgtggttccctgccctgcttcttccagaaacactccccactgctctcctcctcgcgtaggcaagcaccctctaccaaggcctggttctagatccttctggggacagggggcctccccaaggcatggtgagctccttgcaagcagggagaaggtcttccctacaccccacactagcccccgctgtacgagatgagccggccccgcatgggagggcagggagagggcagtctccaccccaataccttccccaggacacccgacgcacagtgcggagaagcaggaaggctctacaccagaccccaccggcctgtgggacaggccagcagacctcatggcctgggcttcctcatctacagcagctggtcggggggtggggcatgtggccactcaagttcgcttgtacctgctctaaaactctatgattttaagacgacactcccagtttcctgaaactgtaggaaagcggaaacatgacgagtctgtgacttataaaaagcaaaaataaatagcggggaaaggcatcttccattcgcggagagcagggagggtggggacggagcggtgagtcactgtttactgttgaaaggcggccacacggagccctctctcagctggccagatttccatttcccgtgtggactggacccgaaacccagaaagtccactccagaaacctttagactcagaaacagctgggacaagaacaggcacaacttcttctccgtctgggtggcaaacagctttgccagagactgtaaacaaacgcagccatcgctgagccccgtgggtgaaagcacacgccttgtagacagcgaagtggcccggaagacggtctcccttaacagcagcctcccgggtgcacacaaaggctggcgccccgacaaccctgaccctcggtaaacgctggctcccgggtttaccagcacctggggagtcgacgctgcgggcaaccagcccctcaaagccctggctcggttcaaggataaaaggcaggagaagcctggtttttctgctttaataaatgtcttattttggaat

SEQ ID NO: 87 - DNA, 2599 bp, Homo sapiens
atagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctgctaaatacacaaaattagccaggcgtggtggcacatgcctgtgatcccagctactttgggggctgagccaggagaatctccaggaggcggaggttgctgtgagccgggatcgtgccattgcactccagcttgggcaacaagagtgaaactctgtcccccccccccccccaaaaaagtaagggctctccattagggcccatagaggacttttaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgagctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacaagtgcaaactattacgggagcagatggagtcaattggccttcatgtgactgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatgtctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggctctttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgagaaaaaaaaaaactaccagaacttgccgttgctgaaaagtaatattttctctttcgagagttttcatggccttttaaattacacccccacctccacaggcaaataaatttgttttggaatgcataccac

SEQ ID NO: 88 - DNA, 4882 bp, Homo sapiens
ctacgccaggctctgaggcttggatttcatgcagtgggatccatctcttttttatgcaattcactttgatttcattaacatttcttatttgttgttagattcatttggagttaaaacagcagatcgttacagttttttaactcagaggtttagaggctgttatattcatgatcctccacaaggtggcaatgccttccttgattagatttttttcttcccgttccatttcactgcaggtgggtttgcgtgtcattgcgttgccaaaacaccctcacccactgttccttctcgcagtgatctgctctagaatttgggggttgggactggacttctgaatatcatctaggtcattttcccattctctggattggaccatacttaaactatcccaagcagatattctcatttatagtactttttaaaacttgttgaattctttatcttttaaagaagataatttctaagatattatgaaatacctattatgtgaaaacaacagacaaacaataaaccccaattgaaactagtctctgggagtggggctcaggcatctggatggtcttaaagcgtcctactgactttcatctaactagggttgaagccaccgctccagtgcgtagcccctaacctcggacacctttgtgggccatgagctgatgagatagtgaggtcagggtctagacaggtgcacccaagttactgcaggagtcaaaagatggccagattgtatctccttagaacatacagaacatctttccggcaagaatattcattcaagaagattttaaagggtgaataacatttcagtaagatataaaaaagacgtttgaggagatagaaatagcaaaaggaaagttagaatcaggaaagtagcgtcctccctctgtggttttaaaaaaagtcgtataaaggctgtaaaattgatttggtgtttttctctccttgtggtaaaccaaaaagtaggttaaatttgttcaagataaataattgatacaagtgaggtttcagagtgttttctatagtattttggtgagcctactttatttttctccaatagtaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatgaggcgtgtggccagagggagagggctggccctgccatcactagaacacaggccgtcctgttcatatgatgcactgccacttccgttttgtgaaaccaggaatcctgaggctcatctttattttttcagaacagacgtagagagatgaaggcttgtggaggaaaagatggtgagagacttgggcagaaaatgagtagtcctcaggaagaaatcttggttatgtgtttagagcatgaaggacagagccatatagtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacaggtgagtgccagaaaccaacagttgtcccgacttgtgtggttatctgaagtaaggcagccggtggctggattagtaactgcatattcccctgggcccgtgaccttgaacgtttgctccaagtcaactcacctataggaattatcactcacatgccctgtcagccctttgggaagtgagatgagcaaaaattgcaagtaatggtggaggctcaaaacatccagatgctattgtaaaaacatgccaaagcaaagcagaggcttttattgcagataaggctgtgttttcgctcagagaccaattgtgtagatgcctaggacataaatggtggggatcgctattgaaattaaattaattattgtaagtaggactcagttctgtaacacatctaatgatatgctgctcagttctgtaacacatctaatggtatgttttgatacagatgcatccaagaagtcagattcaaatccgctgactgaaatacttaagtgtcctactaaagtggtcttactaagggtaagaagctgaggaaagcaagctctctgcctgcctagatttgtgtgtgtcaccccagcctaccctgctccccctaaaagttaaaactgaaaatgatacttttgcaaataatactttgggcagatcccacgtaaggctgattttagatttttcactaatgtgtaagtctctttgctaagtacagtgtttaagactgcagtgagtaattaaatatttgaaattgctagagcttcagatagtttatacattttggtgcttgcatagatgcttttgtaactctttacaggcttaatatatgttttagtgttttaagaaatactaacttctgggtactttggggatgaaatttttcattatgtcgtttgggattgagaacatttaccatcactaagtcatatttatatacctctgctaggtgtttgtaagttatacttggtacttgaatttgtttatttttgtgtttaaagaacatggttggtgcgggagaggtggatgaggacttggaagttgaaaccaaggaagaatgtgaaaaatatggcaaagttggaaaatgtgtgatatttgaagtaagagcgttttcttttgatgtttataacacaagttgtaattggcacattacaaaacattttctacaaacaggacagggtatgctataagtaacattcttactgcagaaggtgacaggcgttggttatttgtacttctcttgctcaattattacagttttaaacataaagacaatgatttcaagttttatttgatgaagaaacaggaatgcttcatgattgaggatcagtatgatgactgaagaccttgattctagcgtgctcagtagtttagttccttagacatgcctttggtttcggtcatttggtgagtatttagtgcctctcacatgcactgcactgtgcggagagcacttggattacagggagcatgctctgtactctcagtggtgtgttcagttgaagaaacacataaaataactgaaagatattcagttactagactaggtagtattgactaagttcaggagttgagaaaaggattagatcagtgaaaaaatagactgccttgtgagcaatagcagatatgggctgcgctttgaaacgaacaggtgggatttgcagggaagggtattctgattgggataatggctcgtaggagacagtgaagatcaggactaccaaaatggaatggatgggcctgttggggattagcagaagtgcttaggtgggtggaattacagagggctaggaaagctagacagagctagtcaaaatgagacctgatgtgaaaggccactagggcaccagcctttttaatctgaaagctctgcttcctctgtttctttatcctgttgctgtttgttgaccacataattatttgtttacgtcatcagctggcacagggcctttatgaggtcagagactgcctagccctgtgttcctggcacctaacaatgcctgtcataaaaacaggcattcagtacgtttttgatgatgaacaaattatacttatttccttggtatttgacaactacttgactgtatatgatgataattagaatatccactctgagaaatcatttaaaagagaaaactcattcaatgcaatctcaaatgcctttactcatcacgctctcattttcttccagattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaca

SEQ ID NO: 89 - DNA, 3061 bp, Homo sapiens
gagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaataaaaaaaaaaaaaaaaaaaaaaaaaa

SEQ ID NO: 90 - DNA, 3494 bp, Homo sapiens
acgcgtccggcggcttctatttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcacttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccctgttttaaaaaaaaaaaaaaaaaaaaaaaaaaaaaaaaaaaaaaaa

SEQ ID NO: 91 - DNA, 257 bp, Homo sapiens
ttttttttttaatcatgcttttctttattcacctcatataaaagtctctttagaatgcatttgaacacaatatataataataatactataacatacattgtgagaaacatttgaaaatgataaaatgtccacctgaaacaatgcagtgttcatagacatacattggtcatgcacatttgtgccattttctgtaattactgagtcacaatgctgaactgaaagcatgaaacatattttacaaactgaaactgacatca

SEQ ID NO: 92 - DNA, 3636 bp, Homo sapiens
gcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaataaaaaaaaaaaaaaaaaaa

SEQ ID NO: 93 - DNA, 454 bp, Homo sapiens
  misc_feattre (306)..(306): n is a, c, g, or t
  misc_feattre (310)..(310): n is a, c, g, or t
acggattgtatattgttttatttttatttagaagtagagaatacagtaatagtgaggcaggagaacagggaattaggatagccaggggtaggggcataagcaaaggaatagcaggtgcagccagtttgcatatacaagagaacagcaggtgcagccgattctaggcaagatcaggcagcatgaggccacatcctcatgcctttatcagtcggcgaatactgtaagagattaagaggatcgttccaataataccagccatcacacactaaataatgagtattacactacaggagctggtacagtganagantggactaagttgtccagtttctccatttgcatgtgatgagatgtactctttgtgactgagaagaggttgagtgtgcatgcacctcagtgtacttaatgctgatatgtcactagttctgacaatagtaatcgaagattattgttc

SEQ ID NO: 94 - DNA, 646 bp, Homo sapiens
ttttttttttttttttttgcagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagagggaacatctcacacccttgcataagttaaaataaatattacgtacacatctccatcacctaggaggacgtacataaatacatataaatattaattgaggagcaataagaaataaattaacgacgctctccttcccaccgggcctagccccagctgggctgtgcctcggtctctatgcgcctcggtctctgtgcgcctcggtcccgcctcaagcacgggtggcgtctccgctgtagtgttctgagtt

SEQ ID NO: 95 - DNA, 3852 bp, Homo sapiens
gtctcctccaagatggcgagcggcggcacggggggtgtcagtgtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccggaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaagaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaagtggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatacggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatccctggcatctgggatactttccatgtttatatatatatatatatgtatatatatatacgatatatatatatatataaactgaaatatatatatatggctcctttgtgccccatgtcattttcagattatggtagcatgctgatacagcaccatgaaagaactcaaggaaaatatatcaatgtaagaagttcactcttagacccagtgttctgaggtcgacgatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggttccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaa

SEQ ID NO: 96 - DNA, 440 bp, Homo sapiens
ctggaaggttctcaggtctttatttgctctctcaacttccaggaattgacttatttaattaatccatcaacccttcatagcaaatatttgagaaaacaaatttatattcaggttcttaacttcattagggaagtaagaagttgcagctcagcgcaccatgaagttgagacagagatggagacatccagcccacttctctggaacaggaaagatgatcggggagggaacacaggtcagtgtggggacaggggtcacggtggacacgggggtgggctgtctctccacctcctcacattatgctaacaggaacgcagacacattcagatgcctttgcagaaagagatgccagacgtcttgaagtcacaaaggagaggtgtgaagaaatcctgcatctcagtcccacacaggcagctgtctcaggctttacaagcgatgagaga

SEQ ID NO: 97 - DNA, 1613 bp, Homo sapiens
  misc_feattre (237)..(238): n is a, c, g, or t
  misc_feattre (241)..(241): n is a, c, g, or t
  misc_feattre (244)..(245): n is a, c, g, or t
  misc_feattre (252)..(253): n is a, c, g, or t
  misc_feattre (1047)..(1047): n is a, c, g, or t
  misc_feattre (1093)..(1093): n is a, c, g, or t
  misc_feattre (1113)..(1113): n is a, c, g, or t
  misc_feattre (1160)..(1160): n is a, c, g, or t
  misc_feattre (1200)..(1200): n is a, c, g, or t
  misc_feattre (1248)..(1249): n is a, c, g, or t
  misc_feattre (1497)..(1497): n is a, c, g, or t
  misc_feattre (1565)..(1565): n is a, c, g, or t
ggtggcgaattccgacgaggggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcnncanccnnaggctgnncccaacctgacgccctgctcacgagggacggaccaacgccactctcccgcacccaaccccgcgctgctgctcccgcttccccgtgtcccctcccgtccggcgctcccccgcctcccgcgctcccgtgtcttctgccatgatattgccccatcccccaaccctaacagcctcactccgcagacccacccacaccccccaagtcctattccgccctccccctatctatgaccacacccccactccactaccacccccacccgtcagtgcacatcccccaccaacccgccgagcaaacctccctatccaccccatacacccgttcgcaataccccacaccccccctcccctccccccgtcctgccctccctccgcccaccttctccttaaccacgctagcctactccacacggcactccgacaacgccaccccgcccccatccgaccaatcgccccctatgccaccgttcttctccaatcgaaccattgcggcccgtcgaccctccctatctcacagcgctaccatgtacctctcttcgtctcctgctacccaccaccactattccactacccctccacctgatgtacaatccaccctccgcttcccccgtcccctactctccccgtatgccgctcatcccgcgcataccgattgcgtatcagatgaccactgcacaatcacaagaccctggcgcatccgcaccatttatcgctgccccgactgtctgccatcccacaaccacacacttatacgctcaccgcccatatacacacactgtcagagccgtgcaaccgtnctgttccgacgagccaggacacaccccacttctccttcgcccccgntgcctcctgtactacccttntgaacacaatacttatcggcaccatctacacacgattttaaaacatngacataatcatgggcgcgcgtaagatcacgacctccacancccccacccatacaactccgaatcaccccccgcccggacgatatatgnnctggtatcgcacggcgtagagcgagaaccgattcgcgacgcgatgagaagatctacacaaaaagtgaccaccatacaccacgcgcgagtgcaccactacccccgcgcgtcacacaatgactgcgtcgcctctcatctcctaacccacatgtcatccgttccggaatagcggcccactcccggcggagagggacgcattactctttccgtcacccgaaccccatttgagcccccccaccaggacaaatngggagcaaccccgccccgccccaattggcatataatatatacactgccgccaaaccaggcattgtatntaatgctaacagatactagcgtttactaaagatacggcgcccgacaaa

SEQ ID NO: 98 - DNA, 439 bp, Homo sapiens
tttttttttaggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttc

SEQ ID NO: 99 - DNA, 4157 bp, Homo sapiens
agcggggcggggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttcta

SEQ ID NO: 100 - DNA, 4151 bp, Homo sapiens
gggaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtgcatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccagcttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttggagagttaatgaataatgagctacaaaccagaacaatgtgactagatagataggatgatctagaattgagaactggcagattgggaaaagagtggctatatggagaaagaaagaaagtagttccatattgaaataacagtctacttaatgaggaccgttgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagaccaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattccaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaaaaaaa

SEQ ID NO: 101 - DNA, 2743 bp, Homo sapiens
gagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaatgccctttctaaacaagagatgcagtctgctggatcacagagaggtcgtggaggtggatctggcaattttatgggtcgcggagggaactttggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaactcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaaaaaaaaaaaaaaaaaaaaaaaaaaaagaaaaaaaaaaaaaaaaaaaa

SEQ ID NO: 102 - DNA, 5783 bp, Homo sapiens
catgttaggttattttcttcctatcctggggccttaccaatgtgtaatgctttcaaagtttctatgaagcctgtgtggattctattttagcttatttatatattctcatttattttgaaggatattatacttaatttggttcagagtagtcgccaggttttgcacctgacaatggcacatattttttgtataactttttctaggtccttacccttttccacactttacatttgtacagtgaaagcaactgccagtggaggcctgaaatgtccaagaaaaaaaaaaatcacacctcttactgccagtggtagtggagtgttttggttagagggaccgcagaaagacagtggccaggctagacagagcagcactttgaaaagagctgggaagatgcctcctagcatagctggaacagatgtgggagttgccattcaggaactgactttgttataggtagaaaatgaaaaggcagatgcttacttatttacctgctatgcttccacctccaagcctaacttagtttttctaatagttttaaattctcttttttctgttctaatgacacgctccttttttaatgtaggtaaggctttatacttctccttgacctgtagtggcatgagagtgtataacatttcctaagatgacaggcaaagtagaactaaccctggcactgccattagctggaccccaccttctgccatctctggccacgaagtcactttccttgtttgcggctataccacagtggtgggactgcccaggggtaagttggtcagtggacagtgttcctcttttctgaaaactgtctgcacaattgccagcaggcatttgctggttaagatgcaaacagttttaaaattcgtcattttaaaaccatacttggcatctaataactacagtttacccaaccatccactcatcttttaaaaaaaaatcattttgattcttgctaaggaataaggttgcatgttttgcagttgcctaaaattagacacgtggaccgtgggtttggcattactttgtacctaaaagagggggaaagctcctggcattgctgtagctgtaaccattccagtgattgtcctttttttccccctacccaactagattaatagcatgtcctccattcactatgtaatttcaatccctaaactgctttagaccttttcttcaagtcaattgtacaaaggcatttattgtatatttattctctgactccttcagcagctcagaagtggaaaatgaagctcctattcagtactaatgggacacccaaacctaatagataatggttttgtgttatttgagaaaacaaaagccaaacagtaaatcctcccactagacatgcagtggtttcaagaagtcacttgtgaattctaaattacatacaaatggaaactaaccatatgtctttaattcagtattaaattttgctttggcttgtcatgtagagtagccttctcaaatttttggttttaatttctgtcaattccataatcattgcatgagcattcaccatcactgaatgctggtgctgtcgctcctaattttcctttctttttaatttattattatttctaacttttttgttttgttttttaacttgcagtgcgagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggaccatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagatttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtgctgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcatcttgctgtttgaaaataaccaatgtgttttctaaaactgtcgtgtaatctactttcattgttaatgcagaattgtcatatatgtaagctgcatgttagacatttgtcttttttaaactaaagtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaaccttaaaaaaaaaaaaaaaaaaaaaaaaaaaaaaaaaaaaaaaaaaaaaaaaaaaaaaaaaaaa

SEQ ID NO: 103 - DNA, 2130 bp, Homo sapiens
tgagatgctgcatttcctgtcaagtatatgctgatcctgtcgaagttttaccacctgcagttaccactttttcatcttttttactgactcgtagaagatgtgtgtgaagttttgacatatttccccactgtcctataaagtgactttgttggtcgatatttaacttccagaacactgaagagaatcatcttcgggtgacataattttgagttagggtgtgtatgatagaaattgttatgcttatcagaaggcatttattaaattttgtggcgctgaccttgtctccaaaaaaaaaaaaaagaattgtttacagaagtaactatagtgtgagtcagaaatatattaatgccattagagaaattcaaatcaataccatggaagttttgatgagggattgcattcaatatgagacgatcatggaaaacttcacaaaggagctgacatttaaactaggtttcttgaaagagtaggaatttaataaagacagtgagatcaatagttgggggttggagaatatgggataaatgaaggaggggcaatggaaaagcacaatacattttgggaaaagtccagtctgactggcacatatgatacgtgtatgggaacagcaggagataatgggaaaaacaggatgctgctagatattgaatggtttttaatacgaggctaaggagtttgggtcctatttctgtaggcaactgtgtgctgttaaataataattgtgttttacagagattaattgtctgaattaggggaaagtgagtcaatacctgttagtgttaggctattaacaatagttaggtgaaaggtaatgagggcattgagaaggaagagtgatgtgttactgtggaggaggaattgatatgaattggtatgacttagcatatagttggatatgggaaaagatggggaggaatgagtcagatcatttagaacttcgtatgttgggaacactggaagatttgagatgttttaaattaaaactgaaattggaatggcaggagatgaagtcaattttgcaaggtggctggatttaaagagataatatttcaaactggaaaacgttaagtgttaagtgctaataggatatgcaagtggaaatgttcagcaaacatttaaattagttaggaaagaggtgaaactggtagtagagatttggaagtaacttgtgcttagcactctcccaggctggagtgtagtggcaccatctcggctcactgcaacctccgcctcccgggttcaagtgattctcatgccttagcctctcaagtagctgggattgcgggcgcctgccaccacgcccagctgatttatgtgtttttagtagagacggggtttcaccttgttggccagcctggtctcgaactcctgacctcaggtgatccgcctgcctcatcctcccaacgtgctgggattacaggcgtgagccaccacgccaggccaaaagcactactatatgacatgttacctgttgtaaagtctggactccataaaccacggattgcaaccatctcattcatctgttcacatattttttgtgtccattgtgtgctcaaagcttttatagctgagaccatgattggtgcctcttctccgtagggatttccagcacacttgagcaaggaaaggtggaaagtgttaagtgttaaggggaagtgtttagagaggaaagcagtctgacatgtaagttatataaatattgagtgaatgaactaggttagaattaggaactacatggatctcagtctgttaagataacaatagtaattcatacaaataagtagagaaagtgtacctgtgactaacttttagtaaaaagtaataattaggcccaggcacagtggttcatgcctgtagtcccagcattttgggaggccgaggcgggtggatcacgaggtcgggagttcgagaccagcctggccaatatggtgaaaccccatctctactaaagatacagaaattagctgggcgtggtggcatgcgcctgtagtcttagctgctggggaggctgaggcaggataactgcttgaacccaggaggcggaggttgcagtgagctgagatcgcacccgcctgagcgacagagcgagactctgtctcaaaaaaaaaaaaaaaaaaaaaaaaaaaaaca

SEQ ID NO: 104 - DNA, 9725 bp, Homo sapiens
cgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaatctttatcctgcctttgaggagctcactgtttagttggggaaaccatttgtaaaacagccattaaccatacagtgtgatcaacactgacaggagcacaggaaaaacatctagcttatgtgaagattcagagaaggcatcctgtagtctaggtggtgatacctgaactgagtcttgagggacgggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaacctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgttaattagaatttaatgaggcattagtggtggtggatgaggggtggccagaaactaaacagcaaaagcaaagagaaagctgcagaaaccataagtaagcagaggtcatgagacatttgtataatgagatcacggagccacagggtggcagaagccatgaagcagcaaggcaacaatgggctagaagccatgaagcaataggagccacgaggaacagaaaccgtgagacaaaactgactatgagatccacaaagcagcagaaggcttgaatagataagatcatgagacagtagaagcgatgagactgcaagaaccacaaggtagccagaaccatgtggcaacatggcaacaggaatggaagaggcagcaggagctacaatgcagaaaagccatggattaataggaactgaagcgccgggagccatgaagctgcaggacccatgaggcagaaaaagccatgggctagcatcgaggggggcagaaagaagttagtcagtagcagtaggaggagtataaatacagccagaaaggagttgagtcaccaatttgggaagcactagagaagggagcaacagatgcctgcagctgagggggtgacaagataagccaggctctagagctgctttggatcatgaaccattttcaagtttctgttcttccatgaggctgcctgtgtagctgttcttgtcttccttatttccctgtgaatgctttaataaatccccatcactaa

SEQ ID NO: 105 - DNA, 3620 bp, Homo sapiens
caaactcctgagctctggcgatccaccctcttcggcctcccaaagtgctgggattacaggcgtgagcccccgcgcccggcccaatttattgtttaattgggatgatgaaaaggttctggagatggatagtggtgatggttgtacaacatagtgaatgcttaatgccactgagttgtacacttaaaatgattaaaatgtaagctttgttacatgtattttaccataataaaacagtgcttgaaaaaagatgaaaaattttctaaatttggtaaatgtcaacccacacattccaaaaaagttcagtgcacctcaagcaagatacatacaaagcaaagcacacctaggcatataacagtcaaactgcttaagaccaaagcaatactagcaacaattagaaaatgaaaaaatatttttaatgacatttacaatactttgaaaagatatgagtatctaggaataaatttaatgaaagatgggttaagtctacactgaaaactatcaaatagtgcttagaggagttaagacacaaatagatgaagatattatttcccattaatttatttatttcccagggactacaggcctttcttcctttaggcagctagggtgaaggtaatttctaagcatcatcttacatatagctaattcttttactaataacagataattcatgtctttattaagaaccttcaataatttaatataaatattttattcattttgtctgagttatttgaaaaccattctattattcaaggacttttcactaattcatgctactgtcaaaaaaaattagtgaaggtttattttatatctgttctatcaatgagcatgcatgctttcatggcctcagaagttttcaaccacttaaagtaagaaaaagaaattatacatcagaatagtcatccaaaatatatacaggtataccttgtgactggattgtccctgagacttcaagagattccagggaaggcagggtgagaagcagttcctgttcggctgcgctgagttccaacttgcttatggagcacttggtgacagaggccttagacagctcaagagctgggcggatgctttctataaagcctctgctgtgttttaaatggagttcgatgcgctgtgaagctgagaaaactgtcattagaatctcaagcatatcctggcctacaacatcaatatcattcacatcgacttctagacagggaatcttgtactgctttggagaaagtttccaatagccagtactaaggtctggtgatgccctgcgctgcatatccatatagctctttacattatcctctttttcagctaaatttcgctcccattcattcataggttcaaaggcagaagcatagtcctgatctatagttggcacctgtgatttgtcaaaacatgtttccagaactgaaaaatgtgctctgggtgatgtcttatttcctcgtattgggaagtggatgctcctcaacaatgacaagctttctgggtggtcgaaaaagtattgtaagttaagcgcacccaaagtcagtgttctcccttgaaggaattgcaaaacaaatggagaacacgcagcaacagtgttgctttgataagcagttttcagggcaagaaccagtaaatgttctgaaaccattgaaaagtaagcttgtggacaaatttgccacaatcccctaagtaactgcatctgcagtgaaatttctggctggtgctttaagtagtcatcattttcagatatattctccaatgactctttgttatccactaaatggagcaaatgagacacaattttgggccctgcttttgttgaagggaggctggagacatagttcaaaaaattgttgtaggcgcttacagtcatcatgggtgagttgatttgtttcaaatgatacagtcccaaatcttgatgttcctgcctatctgaatccaggagttcaatcagcctcatccccgcaagaaattcttggaaggcaggacttaaaaaccggtagaatggtcttagtctctgggctgtaaatttgctcatcaagcacatggttagatcttcatcttcatcaacccctgcttctgcgagatcatcatcattaaactcaaagcaacatgaaaaaaaccctttcaaggccagctcaccacaggaggacacagttgctttgagaatttcagctgtcgctttgttccttaaggaaaggcgttccatataggacttgaaaacagccacatcatcaaaggatgggtcaaaaggatactgaaaccaatgagcacagatcgccgccacaaagagaggagttttctgtatcttctgcaaactttggttctttccaaagtaaaccataaactttcgcagacgagtcatattatgtgaaaagagcttccgtaatatacagacagtattataaaagggaaatgctttgatctctagaatggtctctaggtatcggcggatgtccctggccctgtttgtacggacagcaatcaataggcaggtccgggataagtggtttttttgaatcagttttcctatgacttgagggattgaacatatttctttgtagtcatctaaaaggaataagacctgattctttaactgctggataatgttcctcatgcacatttcagtaacagatccttctttctctaggagctggtcacagatgatactggccagcccctcgtctggtctggtggaactaagggagaggtagaaaaccagctggaacctgtttaacaggggacagcatccagatgcccacagaaaagctattttcttcaggaggaccgtctttccacttccagcttcaccctccacacacatgacagagttcaagttgccaaagacctcaggcagcaccagaggttcttgcacaggtttgctgatgtgttttgaagcaatagacagatcacagcccagcaagtggtccgtggccagatcggaagagatatcaagcaaagacatgtggcggaaactggcgctggtataagctgctctcagctgctcattcagattctttgcctcttgaaaccactgggcttcaccctgtgccatttctgtggagagaaagaaaggggggcacaacagggattcatagtcacatctccctcagtctgaacgccatgccttttcatttcatgattctgcctgtctactacgaatgtgttaggattttccacagccatccatgattcccacattgcgatcatctcataggttttggcacaaaatcggaatgtggaaagcatgtgtccaaagtgccacacttgaagcagggacctagacataatgtgtgcttatcataagcaccatgcatctcaggaaagaggccaggcaaagtgactcatgcctgtaatcccagcactgtgggagaccgaggcaggcgaattgcttgagcctaggagttcaagaccagcctggccaacatggcaaaaccctgtctctacaaaaaatacaaaaattagccaggtgtggtggcacatgcttgtggtcccagctactggggaggctgagatgggaggatcacttgagcctgggaggtcgacgctgcagtgagccatgatcttgccattgcattccagcctgggtgacaaagtaagaccctgtctcaaataaaataaaataaaataaaatgaat

SEQ ID NO: 106 - DNA, 2411 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 107 - DNA, 4788 bp, Homo sapiens
tttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttg

SEQ ID NO: 108 - DNA, 4348 bp, Homo sapiens
cttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatca

SEQ ID NO: 109 - DNA, 524 bp, Homo sapiens
ccccttttagaagctatacataaaaagttgttttccttctgtactgtcacagaacttttacatacattctcagtcctagttgtgaaaggcctaaagagaaagaaactcaatttgcagtccaacacaaaggggggaatttctaaaataaataatccaacagttttttgcatttttttaaattaatttttcatttttttaaaataaaataaccaaaaaagtgtaaagttacaaaaaatgtcgttgaagaataatatattaaaactgtggaaaaaaaggaaaaagacacgtcacaaaattttaagattaatatgaagatcataatttaacataaaagaatatattctatggatttgtcatcccgataaatatgaacaaaattaacaaaaaaaagcatagtttggcaataaatacgttttgataagttaaataagcttttttatattgatgtgcagtgacaagcaaaatttttgctctccaatttctgaaagttatatgaagtttaaaacccagggaagaaagcatgg

SEQ ID NO: 110 - DNA, 1307 bp, Homo sapiens
ctttcgtggaaaaccgatggggaacctggcccccaaggctggtcccccagggaacgggcagcccttcaagaggagcttattgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcatggtggtgtctgaacagcagagagtggcctggccctggagcctttttctagtcttttcagaatagatcatgggcctgaggcctccacttcttgaggtctgaggccccacaacctctagaaggtaccctcctgccgcctgctctcccacccaaatggttttggggcgatccctcccagaatattccttgaatggccaggggaagatctcctgtctcccccccgcccaaaaccggggtaaccaaggggtcccctctggaaaaccccccccccgcggtctccccttgccgtaacctatttgccccgccgtgggccgaaaaccatcttgggtttcctaaccaaaattccccccgaagggatggtccattgtaaacccccctttccccccttctttaaaccaattgaaatggtttgttatgaagttcccccaatcgccgggacccccaccgcccgcaatggggccccaaaaaggtcctttcttttgaacaccttgtcaccgcctaaaattggaacattaaccccaaatttaaatcagtttcccggaaatttcaaacctccccccgccccctttccccctccccccgcgaaatatttatcccccgcccctcacaccgttacaattgccgcttaaatataaattggccccctctttaagcgggttttttaaatgccccttattccccatatacatacaggccactgtccccccccccccaccctttcccccccaccccccgttttttccgtagacacccctcttttttttttcccccccaatagggaggtaaaatcctcggaccaggtctcctcccataaaaaactgaggatcccccgaataaaatcttctccaaaaaagacccaccccgggtttaaactctggcataccaccgccccaccccaatctttctcgatttcccccccccggcgtaaatctttaccaccccccccataaaatttaagccccccccgccctttttttt

SEQ ID NO: 111 - DNA, 4941 bp, Homo sapiens
gggtgtagacaatgggcagctgggcggtgtggtgtagacagtggagcagctgggcggtgtggtgtagacagtggagcagctgggctgtgtggtgtagacagtggagcagctgggctgtgtggtgtagacagacagtggagcagctgggctgtgtggtgtagccagttgctcttaggctgtttttcctgttgcttcaggcctaaatttggacagtgtgtgactgtgctgaataatgtgggcagttgtaacacaacagcaagtatttgtgtatctaaacatagaaaaggtgatgtgttgtgctccgatgttacaatggctacaacatcattagcaataggaatatgtcagttctgttataattttatggaaccactgtagtatatgcagtctgtagtgtaccgaaacaccatcatgtgacacatgtatgtatacagtggatatacacaggtgatctgcaaatattatgccattttatgtctgaaacttcagcatcctcaaattttggtagctgtgggaggtcctggaactaactcccatatataccaaaggatgactgtatataaaactagcctatagaagttggaaatctttctaaaattgaggctaactctgaagttgacttccttttcacattattttccctcttgatttgttttaatcattaaccttatttcagattttttgtattagatatcaatatctccatcatcactgactcctgacacacgcattcacacacacacacacccagaccctatgtgggtctagaactttgtattaagtagctgtttaaacactttgtgtacattctgcagtatgcttgaactctgttgaaagtatttcagtggtccccgtgtggtggctcactcctgtaatctcaacactttgggatgccaaagcaggcagatctcctgaggttaggagttcgagatcagcatggccagcatggcaagacttcgtctctactaaaaatacaaaaattagcctggcatggtggtgcacgcctgtagtcccagctacttgggaggtcaaagcaggagaatcacttgaacccaggaggtgggggttgtagtgagctgagattgcaccattgcattccagcctgggcaacaaaacgagactccctctcagaaacaaaaaagtatttcagtaaaatctatgtatttgaaatagagtcacatagaaagtagagcacatgggatcttcaaaatatattgggtagaaaaatcagaaaacaaaaattataattcattcagaaataaaggagaagaaaaaagggaataaaaaacttcaaggtcagactatgtaaaggtgccctgaaggatacaaagattagaaagcttagacgctgctggatatagatatgtaaaagtgtgagtcagaatactgaaagtaccctaataagtgctttacgttgtaatcacatgggagggataaatgggggttcagaaaattaatgtttgatgcactaaggtaggaatgggccaactatggcctataggccaaatctggcctgctgcctgttgttacgtcctgtgagctgagtgtttttctcatatttaaacggatggagaagaatcaaaatattttgtgacacatgaaaattaaatgtaattcagtgtccataaatattggcatgcacccacactcagtttacatactgcccagttcacctattgcctgtgactattttagtgttacagaggcagagttcatactctctggcccttcacagaaaaaacttgccaagcactgccttaaagcatctattgaatataacgaattaagtcttctcctgtttatctagaatgatatcagctaagtactgtcctgggggaaattgacaaaactcatacaaataatttttctgataacccaggagcttgggttgagaaaaactggattaagtcttactgtgacattggtagaaaggttattgaatgtctggcacgagttgtgccttgaaaaaatggatttcaaccaagattggcctgtggcaatcttgagcaactatgcagagacaggcagtgggaaaaacaattcaggatggcaatgggagcacattctagagattacagaagctggtgtagaaaagcaggatgaaaagttaggttggggccaaaaaccagagaagaaaagtacactggaaaaaggattgagtatcaagtgctgcagaggatctcagaggtcaagaatttagagcggaacgttgagcttggccttcaggagcatgactgtgataaaaggccagctgtgaaacctgtaggagaaatgatgacccagatagtgctgagcagccggctggcagcgttcttggggtccctgtggggatgcagagtggtacaactgcagatggggaagcagcatcattattaacctgtgtttatatgacattcagaaaaatatatgatggcctttctttctcttttcctttaatattagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcgtgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaaaaaaaaaaaaaaa

SEQ ID NO: 112 - DNA, 6792 bp, Homo sapiens
ggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatacttttacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattgaaatctctgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggctgcccgacttgctgctgcatggtgtttgcgctgtgtggctgtggcattacctttccagctgacaccatttctagacaggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagc

SEQ ID NO: 113 - DNA, 1790 bp, Homo sapiens
  misc_feattre (349)..(349): n is a, c, g, or t
  misc_feattre (503)..(503): n is a, c, g, or t
  misc_feattre (774)..(774): n is a, c, g, or t
ggagtgcactgaagatggcggctgctgtaggacggttgctccgagcgtcggtgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagggttcaaagacctaagccttgatgactttaaggggaaatatttggtgcttttcttctatccttggatttcacctttgtgtgtcctacagaaattngtgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtccagacnttacttaagcagatttcccgagactacggggtgctgtcagcaagtctggtcctgcactaagaggctcttcataattgacccatgggtctcgagcattgagcgtaagattcccagggccaaaggggaaaaactcgtgggagggccgtgtaaacatggaatgccgcaggacggtctcaagcagccggtcacgattaggaaaaccgtcgttcacacacaacttctttttcggttgtttttcctttctctattgacgcatctatgacactcgtgngcacagcaaccacaccaccacgcacacgcacaacaagaccacacaacaaacacacgcaccaccaccaagacacacaacgcaacaacacaccagccgacacacacaccacaaccaaccacacaccaacagccacacagccacatacacaacgcaaccacaccgacaacccaacacaccccaaccagcaacagacaccagagaaaccagcacgacaacagaggagaggagagcacaggagggacggcaacgaacaatggaagggcgcacggggacctggagcggcacgcggtgagaggcgagggacaagaggacgcacgaacggacgcgcgcgagccgaaacagaggcgagatagacggccgggagcgcacacacagaacgcgggagacgcgagcgacggtgaccggaagaagacgaaacagcagagagggtacgccacggcgcccgcgacaaggaaggcaacacgaaggagacacagcgacagcagaagagtggcagacacgagaaggagaagcaagccacacaagagacaggcgccgaggtacaggacggagagcccagaggagcgcaaggccgagacacgaagcgaagacacacagagaaggaagagcgagaagacacacagggcagagaccgggcaacaaaacagacacaaagcagaaccaacgcaaagcacaaccccgcagcaagacgcaagagacacacaacacacccacaccacaaaacgaccacacaacaacacacaccaaacacaacgagacaccggcgcaaacaccaggccggagcaacaaccagacgagacataggagcggaccgcagaccgcacgccagacgccgtacgcagagagaccgcgagacacggacacacggacacgagcgtcacaacgcgcaccggccgttcaggccgaccggagacgccccgacgcacgaccggcagcgaagcgagagggaaggacggagagccacgagacggatggcagaggacaataccgacgcaagacgcgagagaacagacgaa

SEQ ID NO: 114 - DNA, 5538 bp, Homo sapiens
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaat

SEQ ID NO: 115 - DNA, 2278 bp, Homo sapiens
aagttgactaatgtgacagtgtagtttaattggtgcagtgagtagcagaaatcggttatactggtttgatcaaaagtttgacctgtttacactttatgaacagactctctttcagattgctggaattctgttgtaacgaatcaaccctatatatccttagaatgctcccttgcattcagtaaccatagctgtgcatgttataatgtatgtgcatggaaggtggctctacgggggtgattgagggactattactggacaaaagagatcaggttaaaggctgttgattcatgggctgctatattactgtccaaaccacccttttgcatttggatcacgtcttggttagaggggggaaagtagcactttttgagaaccttgaagaagtgggagactgttcaacagctgcctgtatctcagtggtggccagtaaactgaaacaagtttataagggaataaaaatcaaccagtgacaaggggttctaatgttaaatgcatatattggcaaaatgccagtagggctatgtagggtggtgagcactcacaattgttcactaaaatgctgtttttaaaacaggaaagtagaatggttgagtgcaaatccatagcatgagataaattgagcttcttaaggcaaatcagcctaggcaaattcatttccgtgtttttgtgtatttggagatgccagctcgtcactcagcccatggagcttacaggtcctgatcacttgatctaattgtatggatgtggtagtttgtcttccctggggcagaaaacaaagctttaatttggaactaaaattgttattattttgcatctaaaggtatgagtttatagacttttgatgttagatttttaaattagaaggtcactgaaaatttcccttaaaaatgaccccaacgaatttgtgtattttgtataaattggtttgttatattaaagcatacatacataatctatatgtgattatgtattcattaggaatcaaactgaattttggccattgatgcacagcactgaatgttgtggaatgtaatttttgtttgtttttgtttctgttttttgaggcagagccttgctctgtcgcctaggctggagtgcagtggcgcaatctcagctcattgcaatctctgcctccagggtttaaatgattcttgtgccttagcctcctgagtagctgagattacaggtgctctaccacgcctgtttaatttttgtgtgtgtgtgtgtgtgttttttttttttgtagagacagggtttcaccatgttggccaggctggtctcgaattgctgacctcaagtgatccacccgcctcatgcctcagccttacaaagtgctgggattacaggcatgagccactgcgcctggccggggaatgtatttaaagatataacacaagtatataactgaataccattgtgaaacattaattatcaatgttttattgtgtcttttaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattct

SEQ ID NO: 116 - DNA, 3483 bp, Homo sapiens
aaaatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaagtgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaggtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcat

SEQ ID NO: 117 - DNA, 2876 bp, Homo sapiens
cgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgccaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtggaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctatataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaaaaaaaaaaaaaaaaaaaaaa

SEQ ID NO: 118 - DNA, 3491 bp, Homo sapiens
gcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaaaaaaaaaaaaaaaaaaaaaaaaaaaaaaaaaaaaaaaaaaaaaaaaaaaaaaaaaaa

SEQ ID NO: 119 - DNA, 5548 bp, Homo sapiens
ggacgccggggcccgccatccccaacgtccaccgcgagctccccagatccatggtctggagcaggtccagaagacgcacctggcaggacgccccgggcgccacagtcgccctccacacgggccaccccaatcctgccgcggctccgtggctctccttacctttacctgaggtgaagcaaggacgtggaagcagctacggcgcgctaccaagcacctcacaccgctctcaacagtactgctcagcctcccggcccgccgatgcgcaggcgacagcagccaacttgatgctcttcacttcttacaaattggcatgccaggctgctgctcaggtaatctgcctcttggaccggctctgaaaatgggacaatgatcagtgcaagatccctgagatgctgagacacgatgggatggaagaaagctatgggacaagtggcctttcataggaggaggagctccttgtcaaatgtgaggagcgaagcaggacaggagcatgagaacaggaagccagaagttatggggacactcaagcagcactagggagaggctcatgagtagaagaactgaggcatcccgcaaacagccatggactaacctgtattgggagcagattctccagctccacgtctgttccttagtctctgttgaggtgaaactccaatatctgaacccaccagccaaataagcaacctgtgtacaagccaagttaaaatttcactcccgtaatggatgaggagaaaccagaagacatttctcatgcacagggagtgcatgaatcccctgaattgccaggtttcagggtcacatgagacctctagaaggctctgctcatcatcaccttatcatctgctgatatacctattctaacgaaggagggagaggagtaatgcacaagaaactcaggccaatgggggagcaagaagaaaacgaagaagtgcagtgcatgcgtcatcggtgtttaacagtcagaagcgaaacagttcagaacaaggcctgccctgtcaaaagaagagctaaagacagttatataaaaattaagaataactcaatctcagtgtgactactgatccgccgccacgtggcttcccggacacactgctgcagcgccaacagtggagaggagctctccatcacaaccagacagcagaagcacagcacagtgaagcacacctgcccacatgatgcacaatacaggtattcatttacaacagatagattttatgccctgtacaggtatgaacacagtgaagatttgacgatggtctctctttcagctgaactctggagttttaattactgacattttcttggaagaaattatcctttgtggttttaaaacatgtgggcttttttttttgttgctcaagtcacatgttctaacaagacagttttaataagccagtttgactagatgtaaagtacttggattaaagtgataatcttactttgtggcctataaattaacacgtctgaatttctttttaagaattcagaaaccagtaacttccaaacaacttgaaattgaataaatattttcagcaacccaggggtgaactaaatgcaacagattactcaactttaaaaagtcttacttactgtacagattttccatattaaacatctggtatgcctcaattttttacttaaaagtctcggactttgagagcatacagcattttttgcacatatataaccatgatgtactttaatattccaatcttaggttgtgattttagaggttgttttggtatcattaaataccaatgggaccaaaccagaaaattaaataaaaatataattcaccactcacacacccttaagggtctagattcaatttccaaaagcataatattgggtagttacttgcagttgtgaaaataatttcaatcttggaatcttggtacacagtcccaaaatttaaaaaaaaaaaaaaaaaaaaaggaaatccactgtaatcccagtgtctttaaaataatgctgccagcccgaccccacctcaccctacagtcaaccagttaccatggttcaggataggacaaacttaggttttggacaaatgaagagttcaatggctgttaattgtcacaggcaagaaaagaaggaaaaccaaaagttgataaatgttaactcaacaattatagtctttacacagcttgccttaaaactgctccagttcagacttactctgttcaaaagtgaatatacagaacgttagtgtatctctctatttaaatctcagtctcagtactaatcttctacctccatgaaacatacacaacaaaacaaaaggaagagctagggatttgggaagaggcacttccagaaaaaaagaaagtgacgattatttcagatttgaatttaccatttttaccattttttctgtttcaaggtcccagataatatacatttcttcattaattattcattttctgagtgcctactatggctggagtactctattcgatttcaagcttagagagagattgaaacagaaacagtaacagtccctgcccatctcacccttcattaacttgctgtgtggaagacaagcatacagactggaccctcatgaggcaatggtagtagggcccacagggaggtgtgctactgaagcaccctgagggcctggagcccaccatgcccgtggagagaggtgctcctgaggagacagagttctgtgcgttctccctatggagtcctgcatttactagatttcaatcctcttcccctgactgatttcaatccacacaccctcccactattttttttttttttaaataataataggctttctgccccaactaaaggaattttaggcttctgcaacaagtggaggaggcattttgaagatgggacacaaagaagtcttctttctccagatccagaagtcaggccttgtaagaattcaagccaaaaaaagttcatccatgggaaaaacggttcttctatcatccagcacgtatttgtgccaacagagctgagggacttgagtaattcaagaggctaggggttggggggcagacgtgtccagtggctcccacagccccgccgtcctgaaagtcacgccagttaatgtgcctcggggtggatcagccctcccgacagatgactactaggaaattaatccccagttaataatgtgctttggaccaagtaagtcaagattatttttcctacaattatacaaagatatgcttttccagaagggaacttctggaaaaagaacaaataacactatgcttaaaatattattcacatatttagagaagaaagaacttaaaatagcagaagacctgaataccatgatccacggtgcccacccctgggagcatgtctttgtgtgagacaagacctagcacagcagggctggctttctaagggtacggtgaggcaccactgaactcatcaaggaactatgcctagtcttgcccctctggtttatgtcaccagtatcaaagagagaggacctctggatgcctgaatgaggcaagaactaatgtgaaggcctcagctgccttaagagaattatgccctgatctggcacagtgatgaatgtctgtggttatactgctgctgccgctggtgtgctgctggtgaggtggtggggtgtgggtgtcttttaaggaaagcgctactattttagctctcttccactccagctctacaaatcagtgcaagtctagttcaggcagggtcaaaccattttgttcacctactttcctgccagtgatttcaaccttgaccttcaaaaatgctctgcaagattaaaagtgatttaagattgttttctttcagtgcaaactgccagttgatacaacctcttcagttcctgcctgccagtataagatagggaattgttgatactatttagtgtaaataaaataatttcttaaacattgaaataccagtaacagctgggggaggactcaccgttagtcaattacacttatgaaactttcaaatagaaattttattttcagtggattctgtttttctttcttaactgcaaaatcagcaagtcattggttaaaaagtatactctccccgcttgaagtcaaacaagtattcaccctaagaggcaaagtccagtatctacagtaaaaactgacctgacctttggtattccgcaagggcctgaacttccattccattcccagtgctggatgtggagaatgggtgatcccaagcaacaatcatttgcctttctgtcaaaagctgtctcggtttaaatgtactgtattttctttgcctcttcttctcatcggaacatgttctagtctactcgccaggtgctacttctggcagtcagaaatagtgccacttttcaacttcaagtttcttaccaaccttttttgcattcatgcagcaagagttcatgaaatagctgcaaagtgctggacactgttaggttgtgggaattgcaagagaaacagtttctgccttctagatgctcacgtctgggggtggggcaggtacagcaggggtgatcaatccacaaaaatttacttttaaaaatgtgttatgggctgacttgtatcaccccaaaattcatatggggaagtcctaaccaccaatacctcagaatgtgattgtatttggaaacaggatctttgcagaggcaattaagttaaaataaggacatcatcagggtgggccctaatctcaagtgacccatgtccttctaagaagagattaggacacagatacacagaggaaagaccatatgaagacacagggagaagacagccatctacaagcccagaagggaggcctcagaagaaaccaaccctgccaacatcttgatctcagacttccagcgtccagattgttagaaaataaatttctgttgtttaagctgcccagtctgtggcactttgttatggcagccctcgcaaactaaacacagtgtgctttttaagggcaacaacaaaaaagaaatatataggttaagtcaaatgtaatagctgctggaacatctatcaacagactaaacaacaaacaaaaccaacatttagcataatatccagtagtgctgtcaacaaaggaaatgggggtggcagtgagcacatctgggagggcatttgatggctgtcagaatcagccaaggaagatgatagaagggtgagggataagtgcagaataagctccatgcaggcaagtggccctgtagccaggtctccctgcagctcctaggggccacagcagtaacaagacccacatgaacccatgagtttctgtgccctcagttttctaactagttcagaatattaggaactgacaatgaccctatcactgaagcttttgagtgctgataatatgagggtcagaaaactggtaagctgatccatctatctagagtccatctgtgcttgctgaactgtaaagctgcccattcttcttggtgctcatcaactgacactccaaacatggacacgtggctgatactgcattccattcattcattgtctgaattcaagtttgtgtttttcatgaaggccaattaaattaactttctttttgacacttcaagaaaaaaaaaaaaaaaaaaaca

SEQ ID NO: 120 - DNA, 3830 bp, Homo sapiens
ccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttagattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaaaaaaaaaaaaa

SEQ ID NO: 121 - DNA, 6080 bp, Homo sapiens
ataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgccttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatctgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaa

SEQ ID NO: 122 - DNA, 9868 bp, Homo sapiens
ggagttgggagtgtcttcagccctaaggcagcatcagagatcataatcttctgctctcgtggcaagaaatttgtgcggatagagttgatacacctcacttgaagttggcctggagaaaagaggcgtcggactcctggacggggttgggaaacggtcaccagtttcggctcaaagcagcctgtttccaggagaccgccatggtcgaggcagcgtcctggtcccacggtgcggggccggacgatcatttatgggatataaataaaaggactatgaggtggtaaataaaagactaccaactagaagccatagggagtcatttgaaggagaaataggcacggctcatctgtggttgagggaaagggatcttgaaagatgattaggagaacttgggttctggggaaagtgcgggaagacattctggcagagaagcaaacgtgaggaaaggtaagaaggcaagaatctcccattacaaagggtttggtgaaaccctttgcctgtccttttcgctcccttcgggagcagtcggcaataagctggaagggtaatggggtgaaaatgcccgtggtcagttccctggctctgcgactcactagatgtctgacaataaacaagttacttagcttctgggagtctgttttcccgattgtgaaatggggatactatatttgttctagagatataaaatattagggtttgcttgcgaccgttaatatcaagatgtgttcagatgtacgaagggaatggatatctgttgggtacacttgatgtgagtgatttttttttttttgagacggggatcttgccgtgttgcccaagctggtctggaactcctgggctcaagcaatcctcccaccacagcctccccaagtgctgggattacaggcatgagccaccacaccaagacgatgtgagtgattcacttgatgtgaatgttgtatttcattgaatggcctgctcttcagactcatatctcgtcatgacctttacaacttctactacttcctgtgtccctcaggaacctagcttttttttttttttttttttttttttttgagacgtagtctagctctgtgacccaggatgaacctcactgcaatctccacctcctgggttaaagcgattcttttgcctcagcctcccaagtagcatgagccaccacgcccggttaatttttgaatttttagtagagatggggtttcactgtgttggccaagctggtctcaaactcctgacctcaagtgatccgccctctctcagcctcccaaagtacagggattacaggcgtaagccaccgtgcccggccttgctaactactttttgtctttcagtctttctggttatacgttgaaagttactttgaggaaacatttgatcttgcagactgggcagccttctggttgcatcctcttagaacaggggtccccaacccttgtactggtctgcagcctgttaggaaccgggcggcacagcagtaggtgatcggtgggccagtgagcagtaccgcctgagctcctgtcagatcagctgtgatattagcttctcacagctcaaaccctattgtgaactgggaatgtgaaggatctaggttgctcactccttaagagaatctaatgggaaatgtaatgagcttgaatcatactgaaaccagctgtccaactcctgtggaaagattgtcttccctgaaaccggtccctggtgccaaaaaggttgggagactccctataggactccacttctgagcactgataattaagggttatctcactctgtatggactatagttctgaggccaaggaaccgtatttaccttgctcactgcagtatccctaggatctagcatactgcctggcacatagttggcattttttgtttcacattccttgcctaatcttgagttccttgagggcagaaactgcccagctcctgatatggcatatggtgccctgccatatttttgtctggtccttccagtatatacaatgcaaagagcatgaaaggtggcttgaactctaggtgctggagggtgtaattcttgtgaattagtaaaaatcatgagaagagctttagacttttactgactagaattgtcacaggtttcaagccagttatgtttagatttcagggggtgggggctccagatgacatggtatacccaaaatgttgtgtgagaaaattgggtatacccaaaattttgttgtattttgttattctgagaaaatgtagattccactgtattctccaaaggtgtttatatccaccatcccctcccaaaagttaagagccactgtcctagtagtactttttagaacattgactttatataagaattggcaattttcgtttctatatcattctaatcctatatactttgtagcttttagaaatgctcagaattctgctgctgtggacttgtttctatttcttatgtcattttaatggagttttgtggcaaacagcctataaatatggggcttaacctgccatttttgaaacaggaatcttccaaaccatagtggtgttttgtttttttttttttaaataacaaatttacatctcacattgtgaaggatggaaagattgtctggtgaggggccactctgattcatagatggcatcttctgttttcacatggtgggaaaaaaaccagactgatctcttaaagcatgtatctgatgccactttcctaccctcacgataaaatccgaactccaaagaagagcagtaagagcttttgtgatctggcctctgcttgccacctccccaactcacataggtctctatacttatttcctagcccccttgcatgctattcacctctaacttccatgtagttatgtgtccccctacctcctggaatttgcatttttattcatctgacaagtgtttgtcttgtatatgccagtgccgtgtattacaccagttgctgtgatacagctgacaacaaagaagacagcccagtgtaatacatttattttctagttgggagagatgggtaataaataaacatgtactatgtttggtggtaataagtttgctgaagaaaattatggaaaggtaagagagattgagtatagactgtggagaattagtctttttcattcacagtatacaattgttttctagagatcagagtccttcctacttttgtgtattcacaataccctattgttaattccatattaagactatatacggtgttttgaaattgtctgcctctggagacttccaagattcattgagagcagaaggttaattttgttcatctttgcattcccagggtcttatatatacataataggctgtatttgttctctaaaaaatacagaaccaataggatatgtacagattatgagaaattggctctgcaaaatggaggtgaagtcccacagtctgccttctgcaggctgaaggcccaggaaagccagtgtagttccaaacccgagggcttgagaatcaggggaggcaataacgttaagtcctagtctgaaggcctgaggaccaggagcaccaacatctgggggcacgaaatggatgtcccagcagttcacccttcttccccttttttgttctattcaggccctcaatggattagatgacgctcacccacatgggtgaaggcagtcttctttactcaagtctactgattcaagtgctagtctcttccagaaacaccatcacagatgtacctagaaatgttgtttgaccagctatcaaggcatcccgtagcctagtcaagttgacagaattagccatctcatcagtatccacaatgtatttttatattaatggatttagcctgagaagcttccatgtacagtatctttttttttttttttggcgacagattttcgctcttgttgcccaggctggagtgcaatggttcgatctcggctcaccacaacctctgccttccgggttcaggcgattctcctgcctcagcctcccgagtagttggaattatgggcatgcaccaccatgcctggctaattttgtatttttagtaaagagggggtttctccatgtcagtcaggctggtcttgaactcccgacctcaggtgatctgcccacctcaccctcccaaagtgctgggattacaggcgtgagccactgcacccagcctcatgtacagtatcttatggtatcttgtcaactcagaggcaagcagaagaaataagacgtgagccaccgcgcccagcctcatgtacagtatcttatggtatcttatcaactcagaggcaagcagaagaaatatttagctccattttataacttgatttccattccactattttcattgtactgcaatgtgagattaacaattccaccccaagtatttgaggtgtgggaagctggatgtaaaaacaccattaaaaacaactcttttcaatggctttctaaggttggctgggctgaaatggcaggttgtggatgctccgtggcacatcacactgcccctttcttcatattagaaattaaatcagccgatggcaatattgaattccaggtaattttccttctttctttttttttgaaacagagttttgctcttgttgcccaggctggagtacaatggcgcaacctcggctcaccacaacctccgcttcccaggttcaagcgattttctctgcctcagcctcctgagtcgctgggattacaggaatgtgccaccatgcccggctagttttgtatttttattagagactgggtttctccatgttggtcaggctggtctcgaactcctgatctcaggtgatccacctgcctcggccacccaaagtgctgggattacaggcatgagctaccatgcccagagaattccaggtaattctcatggtgaatgaattccattcatactgttgttcttcagtctgccaaatggatattacataacacatttgtgtgccatgatgggccttacatatattgactcatgtaattctcacaactttatgaggtggtattagtcacattttcatttcatgaaattgaggcacaaaaaaattagacatgttgaagatcatacatcatccctcacctgggctacaatagcctcttaactaatctctgcttctcctcttgtccacacaacagccagagaacctttaaatatgttaagtatgtcaagcctctgctcaaactgagtttttcctgtcacacttcagtgtggcctataggccctaagtgatgtagcctttgcttatattgtcttccactctcatccttgttcacagagctctagcaattctcatgtttggaggtcctcaaggcaaaactcagctttatttcccattcccttagtatggaaagctatttccctatctgtgtgtcttgcttttacatcattgctctgctctcctcaaaaaccttcccctcttatccccatcaccgtcctcattttgattcttcatatacatttatcctttcctgattttatactgtttacctttttatggtttgttttcccctctaaaacataagttccatctggacaagggctttgctcagtcctattttcctaggccctagaatcaaaccagtattgggtgaatggatactgaatgaagctttacctaagtgctttgtcttttacttagtttcagtggttaaatctcagaaagcttaacagcaattctaagcatgtctttatcataaaaggttaaaaactgtattattgggatattttttctctttttatgtttacctacaagcccgtagaaagtataaatactcaaaagatagcagaccaggtaggcttaagttacttttacaaaacagtagaaataccttcaaatatttagcactgatgaacttactactgaggacatgtggactctactaagaaactaatgatgaaattcataattgggtgtggtagcacatgcacccagctactcgagaggctgcagcttgagtccaggagttcaaggctgcagggagccataatcatgccactgcactccagcctgggagacagtgagaacttggctcttaaaaaaaaaaaggaaaaaaaaattgataacgacaatttgtaatggtcagtcctatccaccagtctaaatgaaagtttaaaaattttcatatactgcacagaagtagatggagtcttaatgctaggtaagggtaaacaagctgaaatagcagtcagtgacttcagagaccatgaaaccaaagttaatcttctaagtccttttaattgttcttataaactagcataagatataaacttaagtagtacacatgagttttataatttactaatctctgacagatagctaagcatagcacatcagagcataacgcagtgtgagggaaataaagtgtacaatgacatcttctattctggacctaataattcaatagagaaagaactacttgtagtcactgtggttacagaaggtttcatggacagcgaacataaagctctactagctaacaaataggtcttaatgataaaaacgtgggccttcagagaactaaaggtaccaatgtgtggcagtccaaaattacgaggaaaatgagttcccttcatgggtcacatcagcaattttttttttccccttttgagacagagtcttgctctgctgcccaggttggagtgcagtggcatgatctaggctcactgcaacctccgcctcccgggttcaagcaattctcatgcctcagcctcccgagtagctgggattacaggtgcctgtcatcacggctggctactttttgtatttttagtagagacagggtttcaccatgttggccaggctggtctcaaactcctgacctcaagtgatctgcttgcttcagcctcccgaagtgctgtgatcgtaggtgtgagccactgtgcccagctacctcatcaattcttaatctataaaccatggataggcttcgggagaacccaagaaccaatgaaatctgttggtaagttttatgtgtgcggttttctacagagagggtcaacagcatgtatattttcaaagaagtctgtggtgcaaaagagagtttattgttagaagtccttgggcaatcaacttggaaaagggtggattgagaatgggggctgtctagatcaggataatgttgaatttgaccctcacttgaggcttttgtacagaggatgagaagacggtaaattcaagggttaatcagaaattaacaccaacatgacttggtgatgagtgagatgtgaaacgtgagaaaaacatcaatgatgaaatcaagcttctgacttgcaacagtgagtataccaagagctacaggcttggaagatgaataaagttgggagcattctgttttttcatgagtgcccatgggacagacagggagaaatggacagttgaaagtacaagtctagacaggcacagtggctcatgtctgtagccctagcactttgggaggctgagatgggagaattactggggttcgggagtttgagacgaacctgggtgacatagtgagagctcatctctgcaagaagtaaaattagctcggcatggtgctgcaagattatagtccctgttagtcgagaggctgaggtgggagaactgcttgagcccgggagggaaagcagcagtgagctgagatcacgccactgcactccagcctgggcgacagtgagaccctgtctcaaaaaaaaaaaaaaaaaatgcaagtctggagaaatatagctgggagtcagtaatgccagttttagctgagggagttaagatcatttaatcagtgttaaggaagaaactcaatagtagtgaccaccaatacttaaggaaaaaggataaagtaagaggaatgataaaggctggctgaaatatcttggcgtctagcctaagaaaggaggggttagatgctcatgtttattaatatggatctagagaagcatttattcactaatacattttatttgtgttctctaatttaaaattaccttttcatcttgcttgattttccttcagctaaattagaaatttgtagtttttcccctaaaaaattcaatggcattctttcttataaattacattctctgattttcttgtcagcctgcttcaaggaaatccatgtgttcaaaatgcttgctcgcagtttgctccataccaaatggttgcttaacccaaatatctgagcagcaaattgagctgatccttctggagaaagtacggttgaacagccaagacctattggttcagcaaggaaaagacagaaaattgagctcaattagtaatgaaaatacaaccttacaaaaaattttatactcagagcagtcctgccacagaaaataaaaagctactgcattattctaatctaaagtagaatctgtacaactgtctttaataccggagtggtaaggtgattacaagaggaaaagcagtcagtattacctgccatgaagagatattttatatatatcatctatcacccttcttatagaactcacttacaaagaaacttatctttttgaaacttctgttcacatacactatccctttcaatccctggcgaagaacaactgaagcaaaataagggtcaaggtaagagtacaaaagtacctgttcttagacaaacttgagctatgttgttttgacagttttctagctaatctttctatctgcatttgaactattttaatatttttgagcagtaaaagtcaaatccgtagaataattttaggaaatgtcaagttacaaataaatattaataagatccaagacagcagaataaaaaagtaacatcctaggggccacatgtctgctcaggcagagtgtcttgaggtggtactattatgtctagtgtttgctagaatcaggggtactattatgtctagtgtttgctatagttccaaaagctcgattttcccgatattcttggaattcatcaggctctttgactcccattatccacaagaacagagtcaaatacaaatcacaaggccaatttactaatttgtattaatacgttattttatggagctccaccccttaatatgtggtattggtcaagttacttcacgttaatttattctcctcttctgtgagaagggaattttaactagtagctacctgatgtgacacttcaatgagttaataacatagataaagtgcttagagcattgcctggtacacagtatgtgctccaagaatgtcaaccactattgttagcacgctaggtagagtgctccactctaatatttgaaataacctgtgcctcctgcccaggactccctttctggtaaaagaatagcttaaattgcagaaaaaaaaaaaaaagttatctagtgagcatgacatcagagatgagaaatatgggcggtcttcaggattttacacaggttactgtaaaactactcctcaaaagattatccccaattctagtgatcattatgtacaagtcctccagattatttgtcactcctgaaacaacactactataaaaactgccaattttttgcttatcatgctccccttttgtaagctccatgggtatctatacaattcctctggcataaatttggttacagctttatttgtagccgctgatttttagcttgagacatttgtataatcacatcttgttaaagatagcttaggcacaaaatttaattctcagagcctataaaaacagtaaaggaaataggcatgaacacacaaggccagataacagcagtaacattttggcaactgaaaggcaaacacagtggtagctaagttagcagaccaagaaaacttaatcaaaattagctggcatggtggtgcatgcctgtgatttcagctacttgggaggctgaggcgggagaatcgcttgaacctgggaggcggaggttgcgccattgcattctagcctgggcaacaggagcgaaactccatttaaaaaaaaaaaaaaaaaa

SEQ ID NO: 123 - DNA, 1529 bp, Homo sapiens
ggaccaatagaatatgtgatgtgtgaattttctttaaaaaacttaaggagtcttggctaccttctgcttgtgagttgtttgggcattcatattaaaagccagcatctcactatttattggacaggtgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttatttattatttattttaaatgtttacatcttctttatgttgtatcaagcctgaatagaaactgatagcattaaaatactcccgttcctctctctcttctcgcttcctttttttttttcaaatttaggatacccaatttgtgttcccacagcgctcgggactggcgggtatacctggttaaaggtccggataaacagggatcacatcctctggacagggtcgcacaaatctcttgtcggcaacccgggaactcgcgcttccaaaaatttcccgtgttgaaggtccccatagcgggtcctcctggagaacaatctggtatagccgggcaaagaaggtctagtcttccccttatcatcttgtttacattccgcctcactaccttttttttcacacaacacaccaacaacacccacccaccccccaccaaccccacacccaccccacccaggcgctgaagaggaggcgagagccgccgcacacgcggacgagcgcgggcgaggcgagggcgggagcgggggaggggggacgagggacgggggacgcgggggggagagaggcggggaagggggaggcgaggaggagagcgctacagcgccacgacgagcgaggacagcaaaggagaggaaacgcgaggcggggcgagacaggagagaaaggacacaaaagggagcgcgacagggagagaaacggcagcgacaaagaagagacgagagagacgacacagaggagagacaggcggagagaagagaaacgtaagcagagaatagaggaagagaaggaaccagagcacaagaggggacgcggacaacagaggcgcagagaaccaagagacagagagagacaggaacgagaggcaagagcaaacaaccagaagcaaaaagagaccacgcgagagcacgagaggaagcgagagcacacagcaggaagccgagcccaaagcagaggcagagacgcagaaggcaacgaaaggcacgcaagcccgaagcagcgcaccacagacacacgaaaacccagcaagcacgaacaccaccaaacacagcaccagcaagcgacgaagccgacacagaaaccacaagacaaacaccagcgacacaccgcaacagcaccacgacgcgaagaccaagagagacaacagacgcagcaaacagccgaagcaccagacaaca

SEQ ID NO: 124 - DNA, 3197 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcggcaacttctccgtgttgatggtggacacaaggggccagccctggacccagaccctccagctcaaggtgtacgatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatgactcacttgtcaactagtggactaattaaccctccaccaaaaaaacacaaagtgcttctgtgagaccaattttgtgctaatgagcattgagactgatgctttgtaagtcacaccacaacaaatattgattgagggcgctgcatgtgctgggtacatttcttggcacttgggaatcagtagtcaagcgaaacccttgcctttgagagtttatggtctggataatataaataaacaagtaagcataaaaaaaaaaaaaaaaa

SEQ ID NO: 125 - DNA, 429 bp, Homo sapiens
  misc_feattre (90)..(90): n is a, c, g, or t
  misc_feattre (410)..(410): n is a, c, g, or t
agcttgattaggttattatctgtcaaaccttttaagttgacaacatgactcatatatatacatgtgtataagatgagcatgtgtcgaagnttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttaagagacctgctttacaaaggttggcccttgattggcatctgggaacttggagttcagggggcttccaccattcccagaactgatcaaagtaagcttactatatctaaactgtaaaaccatataggtttctcctggaacacctggctttccctccgggagtcngggaattttgggtaaggtg

SEQ ID NO: 126 - DNA, 3058 bp, Homo sapiens
ggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgagacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatggagaatagagatgtggtgcccactaggctactgctgatagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatccactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctgggggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattaataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaaaaaaaaaaaaaa

SEQ ID NO: 127 - DNA, 4369 bp, Homo sapiens
ggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctggtttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataaatgtttgattatctttagatgtgatatagctagttcccaaagtgattgtacctaggattgtaacttaaattaacgaggggaaacgacatgctgggacccttgagaaacgaaaggcaaatccctagcttagtttctaggacttatctgagagtgtgatttcatgcagtggtaataagaagattattaaaagccatccctattctccgttttcattaactttatgcaattgctatatcttctaattgtatgtagtaagtttccttttcctttggttctttcctgatgatgtctcttccttccagttttattagcttgctcttggctgtgatgtgattcactaaccttttctcttaatttttattgtgtttaatttcttctttggcactctaaagcctggctaattgttctaggtttatgaatttcacctcttacatgtaaagggtataagattttaatgtaataggtcaaaaatcagattattttcattcaaatgaggatgatgagtcactgtaatatcaaaaaatccccagcagctgggactgaagggaagcagagatcatgaagctttctgaatgagaagtctgatttttggaacagtcccctgaagaccaatgttggtcggcagaattagcaaactggcaaaatcacattgcaggaacatattggaaaaattgtaccctttactaaagaaataaacttcaatattttctcttctaaccaacttaaaagacaccaatctacctaactcatctggctcaagggacttggactggaggatacaggctaaagtgacacttatcagaatcttcctcaagcacttgctggaaaagatatcagattggaacttcttgtttaaaattaagctttagtaaaacaaagtgatgaggttaggaaggcagactctacacatgtcagattgacatatccccacaatttccggaacctacatgtatagctgtttacaaaatctccaagttaattaagggcactttagaagttgtcctcatgaattagctagcattagcataattaccgacgttgcatgctgtgaggaggctacaaaggccaggctggtgtcggaagtaataatacatatagaaattccattctaataaatgccattagtgtataacatcaagttctgtgtaatgaggctatttccaagtcccccaaagatggtcactgttacagcactttgctgagagggttttaacaaatcatattagccaaaaagcctacaacatagatgcatttagcaaaccatgtacaaatcaatcactataataaactgcatcatttgatagagtcaccgtttttgcatgtagtgttagagtatcacaaaatataacaagttttactaaaggatggttggttttttcaggatttaagggaatatggacaaattgttaaatagtatttatttgataaatgggagtttgtatgcagaaagagtgaattgcgtataaaaagggtgatttaaaaacccagaaacaaaaggtagaatagggctgaagcatctgataataggaaaagaaaaggacaaaagtcctcaacttgtgagcaatatgctttccctttacaccctgtaatttattcaaatgatattaaaatacaagaccattgcaatttatgcttttcgcctggcagttattttcccccccaagctatcctgtttcagataatatcaatttatttccaatccatcagactaaaatctaagaaaattcaagaactcttttattgttgatttggtgccaccaaattctttttctttttaaatctttctaattatcctttctttttcaatcccattgctaacacccagaacatattttctgttcaatgcaaataaacattcactttttacctaaaaaaaacaaaaaaaaaaaaaaa

SEQ ID NO: 128 - DNA, 5031 bp, Homo sapiens
agaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaatatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccagatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttctgcctaacagcattttatgccttttattccacattaaatgggaattgtgcctacttaggagtgcccctccaattaattacatgtgtccaagaataatccaagctagagacacaaggtgggaaaacatttcaaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaagaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagcaaaaaaaaaaaaaaa

SEQ ID NO: 129 - DNA, 360 bp, Homo sapiens
  misc_feattre (102)..(102): n is a, c, g, or t
  misc_feattre (148)..(148): n is a, c, g, or t
  misc_feattre (172)..(172): n is a, c, g, or t
  misc_feattre (178)..(178): n is a, c, g, or t
  misc_feattre (183)..(183): n is a, c, g, or t
  misc_feattre (186)..(186): n is a, c, g, or t
  misc_feattre (195)..(195): n is a, c, g, or t
  misc_feattre (197)..(197): n is a, c, g, or t
  misc_feattre (202)..(202): n is a, c, g, or t
  misc_feattre (208)..(208): n is a, c, g, or t
  misc_feattre (231)..(231): n is a, c, g, or t
  misc_feattre (250)..(250): n is a, c, g, or t
  misc_feattre (263)..(263): n is a, c, g, or t
  misc_feattre (295)..(295): n is a, c, g, or t
  misc_feattre (300)..(300): n is a, c, g, or t
  misc_feattre (309)..(309): n is a, c, g, or t
  misc_feattre (349)..(349): n is a, c, g, or t
aaatttagaaatttattctgtttaatccacaagctttatatagctttagtttaaaaaaaatcaaaacaaaaaaaaaaatcaaaacaaaaacagtgaaaccangacactattccaaagtctgggcccttccagccttccaaatacaagnggctctgaaagttgtatataccanttgggngggancanggacaaaantntggancagggnccatggacatttcattaaacaanttgtatggtaactgagggntcctttcgggggnctaggctcattgcctttacaaagggaaaaaancaaancaaaaaaancaaacccggtttacgggtgggggggtcccggtgtttcccnattcacttggt

SEQ ID NO: 130 - DNA, 398 bp, Homo sapiens
  misc_feattre (195)..(195): n is a, c, g, or t
  misc_feattre (244)..(244): n is a, c, g, or t
  misc_feattre (248)..(248): n is a, c, g, or t
  misc_feattre (281)..(281): n is a, c, g, or t
  misc_feattre (305)..(305): n is a, c, g, or t
  misc_feattre (344)..(344): n is a, c, g, or t
  misc_feattre (351)..(351): n is a, c, g, or t
  misc_feattre (362)..(362): n is a, c, g, or t
tttttttttttttgcagccagcttgctgtttactttcaactcaaagtgttttctgttgtatatccatgtcatcacctcttatttatcaggaagtgacacaaagtaacaggcttcacaatgccatcaatgtcattttgacagcattcatgtcacaatacacaatcatgtactgtaattatacaaaatccaaaggantaaaatgttactagttacactcgttaaaatgtaaactggacaaccaaanggantaacaaaacaaaaaggaaatctctgatcaggantccataggggacatttggacaatnttacaaaaaaaggtgttcaaatatttggtcccggcatgnctggcgnttcattggccnttaactttcattaattccccggctctttgggggggg

SEQ ID NO: 131 - DNA, 3502 bp, Homo sapiens
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaacc

SEQ ID NO: 132 - DNA, 4200 bp, Homo sapiens
ccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtgg

SEQ ID NO: 133 - DNA, 939 bp, Homo sapiens
tgaggggatctgacggacccctgacaaattcaatttctttcccattccgggcccttccctatcgtcgcccccttcaccttggatcatgtgcaagaacaaaaattacttggcagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaacacctaagattacttcacgaaatatccttttatcctgccacaccagcaggttgataacaggagccatcaaatttgtactcagtggagcaaatatcatgtgtacaggcttaacttctccttggagctaagctttaccctgtctgcagtagataccatggttgctatcatggcaggaagggacaaaccagcatgctctatgttgtgggagtcatgacagatgtctgcagacgacactcgagacagtccccaaacggaatctggccttgcaacactactccattacttttcactgatggggctgttgcctatgacggactctaacactgcagctcaaacgggcatgcccctggggctaaatatggctctggggacgcacacggcgcacgcacaccgtgtgttgacacactaaataaggcccgaggaatgacgataacattccaccggcatggcacgactccagcagcacaagagagcaacaaaaaaaacgtcgggcgcagcagactagagagtgtgaacagacgagcagaccgcggacacacgacgggcaccaccacgcagacaccaccacaccggactcaagcccggactccacacac

SEQ ID NO: 134 - DNA, 448 bp, Homo sapiens
  misc_feattre (162)..(162): n is a, c, g, or t
  misc_feattre (179)..(179): n is a, c, g, or t
  misc_feattre (274)..(274): n is a, c, g, or t
  misc_feattre (352)..(352): n is a, c, g, or t
  misc_feattre (414)..(414): n is a, c, g, or t
  misc_feattre (434)..(434): n is a, c, g, or t
tttgtttgaaaaaaaatggaaaatttattaattagacagtatgtgggcatcctgttccacatgggaatgagaagatgctataggttctctaagtattgcacagtctgaaaaaataacaaaaaaagggaaggggaggaaaaaaaaatcacatgatattggganccatctcacattatgantaatctaccaagaaacatttaaaaaagaaaaccctttgtttctacagtagctttaagtttatagttcttgggaatgactgtattcccattgaagncatctcaggtaacaggggaggctgttttaggccaatccccatggtggccaaatatttaattaaaaaatattattaaanttaatgccaattccatcctctttgcccttcacccccggggccaatccatggaccatttctgnggggacctgtttttgccttngaatgggggggtag

SEQ ID NO: 135 - DNA, 3834 bp, Homo sapiens
tgaactgtaacagtcgtctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttggtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgctgagatgtgtgatttttctttctcaaggatcatggcgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcctaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggcattttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaacgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaaaaaaaaaaaaaaaaaaa

SEQ ID NO: 136 - DNA, 3024 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaaaaaaaaaaaaaaaaa

SEQ ID NO: 137 - DNA, 2662 bp, Homo sapiens
tgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccacgactgttggcccacccattgcagggttacttcgtggcaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgagaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaaagtcctacatttccagaactttctggcaaagatttgcactcatattatttatcctatgaacattcccattgtttttttttgctatttatatacagattatcataagaaagctctcagtttgaggacccaaaataaaaccaaagtcatgccatgacccatactcatttacagaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggctcttttgcaggaaaaaaaatctacttttgaccatactaccctttcatgtccttattataagcttttagaaaatgatttcattcagtcatgtccagttatataaaacgttactttctcatttttgagaagttcaacaaacatactactaagaccatcatcaacccactattataaatgttaattttggctgggtaaggtggcttgcgcctataatcccagcactttgggaggctgaggagggaagattgcttgagcccaggagtttgagaccagcctgggcaacatagcaagatcctgtctctactaagaaaaaaaaaaaaaa

SEQ ID NO: 138 - DNA, 727 bp, Homo sapiens
ttttttttttttttttttacagcttcatatactatttattaagttattaatatgaacagatatgcaacattacagatgtctttcaaagcctgtaataaaatatagtccactatccagcccaggagaaagacaacaaacagtatcattcttatagtaagtgtagcatacgtactcacaatagttcccttatttggacatcaaagggaacaatcagtcaagattctttacctccattagaatttaactttcttggattatagctgttttagagtcaaaagtccaacttagattatccacagagatgtgtagcatcacatgttggagaggaaggagatactgtcacctccgtggcagccctttctactgtcttgcagtccttctatatcgaagcccatcttgccttttaggccagtagtggtcaaatttgggtatggggagaaggcaggtgggtcacagggaggttttgattaatttacaaagattgtgtttcaaagctctaaaaacccattttggtggtggcagtggcagtgaagagtacactatatttcgccaagggggtcttctcatctcttgagtcttggcttttcatatcctttaaaattgctgcagttctcagtgggaaagtggaggtggcaaactctaacagcgattggtatggggccatctgcagaatgaactggactggctactatggcttttataacctgctttcctttctttagtctag

SEQ ID NO: 139 - DNA, 5397 bp, Homo sapiens
gcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatgactgactgattccttctctggaatagttactttacaacacggtctgttggtcagaggcccaaaacagttatacagatgacggtactggtcaagatgggtcaagcaagcggccacaagggactgaggcaagcacaatggtttcaaagaaagactgtaagctccatgattagcataaagcactaaccatgtctccatgtgacccgatggcacatagatgttgtagaataagttatgggtttttatgttttgttttgtgtttttccaaaacttgaacttgcaggcaagccttggttgggtatttgatttatccagaatgcttctctttagggaacaaggatgtttttaatggcataacaaaggcaagactctgccttaatttttgaaaagctgctaactacatgaacacaaatgtgtatttttgttgcagtgtagttttccttttgtgtaattttaaagtcagtgttgaattttattgaaagctcatgatgcgcttcaaagtggcaagtatttggctattaactgccaaaacaagagcctgattttttgaggccagtaattcgtttgctagaattgattttttttctctctctctttgttacataagggcattatgtaacactagccgaatggtagcctctgggttgttgtttttttcttttcctccatgatgttaatgggttatctcaaattttaagttaaactacctaaaataaataccaaagataatgcatatttttgcacagtggagcttacacttaaaagaaaacaaagccccatgggctgccttgaaatcaagagacaataactttgaacctcagcaagaccttgaaccgccggttcattttgcaccttattcagaaaatagagcatcatactcaccgagtctagtcagtgtagtgcttttaaaaattttgtcctttcatgtaacttttttattttaagaggaagaagaagaaaggggcacacacacacaataccgacgtctatcctttcctgctaggcagtgctggccaggctcatgtgtagtgtgcgagatggtgatgtactcttatatttttctgggcttttccttttgcacattccaaaattcatttcataagacaagatcttcataggacctccttggcatcctggcattctcaaaactgagccatccagcatgaaagataaatgggtttaaacccttgctgctgaatttattgcctggactgtcaggacatcaccagcccaccttcaccttagggaagatgccacacctggcctccacacttgctcttctgatcagtctgtctggattgagtcctacagtgtcagatagggcggcaaatgccaaagcagggaaacagggaggtgtggacaagccagtttgatgcagcacttcagatcaagtgcttaggaaggagaggaaacttgccttttttatggcagaggatagtaatgaaaatgtctcagtattttagggtcaatgagagccataaaaatataacataatcacaagtaaaggagataatggtctaaaacagctatttcccttttctgtgtgcatacttatgactgaatgtgagctaagcattttctcctgtggagccctagagcaggttactaaggaaggacacattgttttccagaagcctcccctgcctggctgactgccttgctagaaacataattttttttttctcactgaagctcaataatggaactctttttttttttttttttaatttaaagttccctatttgtgaattctgggattactgacttttctttttaattggagtctcaaaatcaactctcttatggtattatatctctgtatgccattaaaaaacagcttgttctagaatcatgtattttgtaaactgatgtttgtgatggtctctggttcttgaacagccatatctgaatgccgtgcctgcaaaactatgacaatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcaacaatttggttcttgacagtgagaggatattgagggcttcagctgctgctattatgatgttttgcaaaggaaaataatcaaaccaaagagtattcagtgatatgtaaattaaatgaagatacagtggagaatgggggtgaccacaaaagaggctccccctaaacacacagtgctgccacttaaaaagacttgagaaatttgaaagggggtgggtatggggggggcaagaaagagggagggaaatctttcaacttatttctgaaaaagagaaaaaaatataaaatttctggtgcacaggtttgttttttcaagaaaattttgcagaagctatgtttttaaagtgtacattttataaagtttatcagatattttcatatttaaagccaaatgtaaatagaggtctgtaaagaaaaataattgccatagaaagtataatttcagtgcagtaatttctgagagctagtacctatatgctaccggttagcatggttttagcaaatatataccagccttataaggttcgtattgctatgttcttctgttatttatttcagcatggactgttcatttgaaacctttttctagttattagcgttttaacagttacaagctttaaatggcaattttttttttttttttttttttttttttttttttgtcaagagccaagacacaggtaatgcacgacattgattgctgcattttaccttcaaaatatttgtccttattgactgggtctccttaattaatgtacacatgtcattagaatgcagacggaggggactcaccatgaatatctggggttgattcccagatgtgtgttgcttctctattgcaagcagattccctgttggatttacttcggatttattcccttttaaagaatttttgcccatatctggaagggcactatatttttgggaggagccatagattcctggttatcctatttttaaacaaaatgtagacaaagtgaactctattttgattattgagaaaggagtagttttctatccctctaagagtatacttgaatcagacattttaaggatgtcactatggcactgttgtcatttccaaattcctagaaaagtttgttttactttgtttttattctgttaatgcattctttcttctctttacttcctttcttaccagtacactcctatctcaactctgtttatttgatgagttctgtcccgtaaatcatatttcccttacaattaataaatgtcacttcatattttataataaaccactcagtaaaagcaaaagcttgtcctgagaagtagagtgagttctttttcactctgtgtctaataatgttaaggtgggaaaaaaaaaagtgtggcatagctacctgcccatccccaaccctcagcaaagtagaatctcttttctggtaattttgggtttccgctctgggctctggcaagttgaacaatcctagccattgacaatcgtgatagttattattttcccatttgctgtctttttgtatctaaagtcttcctattgtactgcacaaaccatggattgtacatatttttatatattatgtcttattttattatttctaaataaaaaaattaaaaattgaaaaaaaaaaaaa

SEQ ID NO: 140 - DNA, 584 bp, Homo sapiens
  misc_feattre (456)..(456): n is a, c, g, or t
  misc_feattre (472)..(472): n is a, c, g, or t
  misc_feattre (523)..(523): n is a, c, g, or t
  misc_feattre (540)..(540): n is a, c, g, or t
  misc_feattre (569)..(569): n is a, c, g, or t
aagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattcgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttccgtagtgtgggaacagtggttttgctctataccactgaaaagcactataacataattgttgtccatgatactgaagcttttcccctcacttctaggttggtttacattcagagctcctatcaataaagagggaatacatattacagtggaantccgacaaccggcacnagttgggcagtaaggtatcccccacctaatttatcctgggtaaatcacccnggttcccaagtgctgcngggataaagagtggttaccttttaatgcncctagacagggtagt

SEQ ID NO: 141 - DNA, 3672 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 142 - DNA, 2189 bp, Homo sapiens
gcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 143 - DNA, 1103 bp, Homo sapiens
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 144 - DNA, 776 bp, Homo sapiens
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctagagctgagtgcctgaggggtccagaagcttcgaggcccagcgacctcggtgggccagtggggaggagcaggagcctgagccttgggaaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagcacgctcttttaaaaggt

SEQ ID NO: 145 - DNA, 2690 bp, Homo sapiens
ataaaaacccagaaagccccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcattaaaaaaaaaaaaaa

SEQ ID NO: 146 - DNA, 2805 bp, Homo sapiens
aaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatacgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgaaaaaaaaaaaaaaaaaaaaaaaaaa

SEQ ID NO: 147 - DNA, 1700 bp, Homo sapiens
gcgggcgcggactgaggctgcgcgccgcaggttccggctgctggcggcgttgcggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaagccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggaaaaaaaaaaaaaaaaaaa

SEQ ID NO: 148 - DNA, 925 bp, Homo sapiens
gcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaaaaaaaaaaaaaaaaaaaaaaaaaaaa

SEQ ID NO: 149 - DNA, 2494 bp, Homo sapiens
gagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaatacaaaaaaaaaaaaaaaaaaa

SEQ ID NO: 150 - DNA, 2381 bp, Homo sapiens
ggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacaaaaaaaaaaaaaaaaaaaaaaa

SEQ ID NO: 151 - DNA, 3215 bp, Homo sapiens
gacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 152 - DNA, 3164 bp, Homo sapiens
aaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaa

SEQ ID NO: 153 - DNA, 9688 bp, Homo sapiens
ggctcaaacatggctgcgctgagagctctattgctttgggcgccgggagcaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgagatgtgggcaggacatcaaccctcaaagagtagcctgggtctggcttcttgtactggagaaatggttggcccgggaaaagaagttactcccagttgttttccggagaaagcttgagtttcttttattgtcagaagacctccaaggtgacattccagagaacatcctcgaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcattgcgggctttgcagggccctgattcggtgccccctggggtagtcgatgccatctatggagccctgcggactctgcgttgccccgcagaaccacttggggttgagttgcatctcctgtgtgaggaactactagaggcctgcaggaccgaggggagtcccctgcgggaggagcggctgctcagctgcctgctgcacaaggccagccggggcctgctgtccctgtatggccatacctatgcagagaaggtcacagaaaagccaccgagggctacagcctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactctctctcctccccaggtgctgcaaatctcttctcaacttacctggccaggtgtcaacagtatctgtgcagtattcctgactctctgtgcctggagcttctggaaaacatcttctcattgcttctcatcacctctgctgatcttcacccagagcctcacttgcctgaggactatgctgaggatgatgacattgaggggaagagcccctcaggtttgaggtccccatcagagagccctcagcacatagcacatcctgaaaggaagtcagaacggggttccctgggagtcccaaagacccttgcttatacaatgccaagccatgtgaaggcagagccaaaagacagttacccagggcctcataggcacagctttttggacttaaaacactttactagtggtatcagtggatttctggctgatgaatttgcaataggggccttcctcaggcttctccaagagcaactggatgagatcagtagccgcagcccccctgagaagccaaagcaagaaagtcagagctgctcaggaagcagagatggactgcagagccgcctgcatcgactttccaaggttgtctctgaggcccagtggagacacaaggtggtgacaagcaaccatcgttcagaggagcaaccttcccgaagataccagcctgccacacgtcaccccagtctccgccggggtcgtcggacaagaaggagccaggcagatggccgagacagaggttcaaacccatccctggaaagtacaagtagtgagctgagcacaagtacgtcagagggaagtctgagtgccatgtctggccggaatgagctgcacagtagattgcacccccatcctcaaagttcactcatccccatgatgttctccccacctgagtcactgctggcatcctgcatccttcgcgggaacttcgcagaagcccatcaggtgctgttcacgttcaacctgaagtcctcacccagttcaggggaactgatgttcatggagcgctaccaggaagtgatccaagaactggcccaagtagagcacaagattgaaaaccagaactcagatgcgggtagcagcaccattcggagaactggcagtggccgctcaactctacaggccattggcagcgctgcagcagcaggaatggtgttttactctatctctgacgtgactgacaagctgctcaacacctctggagaccccatccccatgctccaggaggacttttggataagcacggctctagtggagcccactgctcccctgagagaggttctggaagacctcagtccccctgccatggctgcatttgacctagcttgctctcagtgccagctctggaaaacctgcaagcagcttttggagacagccgaacggcgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagaatgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgcttagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacatatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgaaaaaaaaaaaaaaaaaaa

SEQ ID NO: 154 - DNA, 66 bp, Artificial Sequence
  Synthetic Primer
ggccagtgaattgtaatacgactcactatagggaggcggttttttttttttttttttttttttacg

The invention claimed is:

1. A method for determining the sensitizing potential of a chemical compound, comprising the steps of:
   (a) providing a suitable cell culture of a specific cell type and providing a test sample and a control sample thereof, said test sample and said control sample being identical,
   (b) exposing said test sample to a chemical compound in a solvent and exposing said control sample to said solvent for a predetermined period of time,
   (c) determining for the test sample and the control sample gene expressions for a subset of at least 2 genes selected from the group of genes consisting of SEQ ID NOs: 1 to 29 and SEQ ID Nos: 31 to 45 respectively,
   (d) for this subset of at least 2 genes looking up in a database the gene expressions for a set of control and test samples, the test samples being exposed for said predetermined period of time to a set of chemical sensitizing model compounds comprising both sensitizers and non-sensitizers,
   (e) using the gene expressions of the said test sample and the said control sample of step (c) as input to a statistical classification model that is based on said database and that is trained and optimized to classify chemical compounds as either sensitizers or non-sensitizers using gene expressions for said subset of at least 2 genes, and
   (f) predicting through said model whether the chemical compound tested belongs to the class of sensitizers or to the class of non-sensitizers.

2. The method according to claim 1, wherein the model is discriminative in nature or is probabilistic in nature.

3. The method according to claim 1, wherein the model is selected from the group consisting of linear or quadratic discriminant models, logistic discriminant models, tree models, nearest neighbour models, neural networks, and support vector machines.

4. The method according to claim 1, wherein the database is a dynamical entity in time.

5. The method according to claim 1, wherein the optimization of the model is an iterative process used to fine-tune the model and to select the final subset of the at least 2 genes.

6. The method according to claim 1, wherein the exposure time is between 15 minutes and 48 hours, preferably is between 3 and 24 hours.

7. The method according to claim 4, wherein gene expressions for the test compound and/or the chemical sensitizing model compounds are determined for 1 to 3 exposure times within a time window.

8. The method according to claim 1, wherein the database contains gene expressions for 1 to 3 concentrations of the chemical sensitizing model compounds.

9. The method according to claim 8, wherein the concentration(s) correspond(s) to (a) concentration(s) that cause(s) from about 0% to about 40% of cell death among cells exposed to the chemical compound, preferably that causes about 20% of cell death.

10. The method according to claim 8, wherein the concentration(s) correspond(s) to the highest soluble dose of the compound in its solvent and 1, 2 or 3 dilutions thereof.

11. The method according to claim 1, wherein in step (d) one of the non-sensitizers is an irritant.

12. The method according to claim 1, wherein the gene expressions of the test and control samples are expressed in the form of a logarithm of the fold change.

13. The method according to claim 1, wherein the suitable cell culture is a CD34-DC cell culture, or another antigen-presenting cell model.

14. The method according to claim 13, wherein other antigen-presenting cell model is CD14+ monocyte derived DCs, or a MUTZ-3 cell line, MUTZ-3-derived DCs, a THP-1 cell line or a U937 cell line.

15. The method according to claim 1, wherein the step of determining the gene expression(s) comprises a step consisting of a method selected from the group consisting of cDNA or mRNA microarray, multiplex real-time RT-PCR, multiple singleplex real-time RT-PCR, competitive RT-PCR, RNase protection assay, Northern blotting, and protein dedicated (micro)) arrays, multiplex protein analyses by a Luminex system, Elisa, F ACS, reporter assays and Western blotting.

16. The method of claim 1, wherein the sensitizing potential of a chemical compound for allergic contact dermatitis is predicted.

17. The method of claim 1, wherein the sensitizing potential of a chemical compound for allergic reactions selected from the group consisting of respiratory allergy, asthma, allergic rhinitis, allergic conjunctivis and food allergy is predicted.

18. The method according to claim 1, wherein the at least 2 genes are selected from the group of genes consisting of SEQ ID. NOs: 1 to 29 respectively.

19. The method according to claim 1, wherein the at least 2 genes are selected from the group of NINJ, PBEF1, CCR7, CREM, MAX, ENC, CCR2, PTGS2, CXCR4, CD36 and CLTB.

20. The method according to claim 1, wherein the at least two genes are CREM and CCR2.

* * * * *